(12) United States Patent
Shiffman et al.

(10) Patent No.: US 8,216,786 B2
(45) Date of Patent: Jul. 10, 2012

(54) GENETIC POLYMORPHISMS ASSOCIATED WITH CARDIOVASCULAR DISEASES, METHODS OF DETECTION AND USES THEREOF

(75) Inventors: Dov Shiffman, Palo Alto, CA (US); James J. Devlin, Lafayette, CA (US); Judy Z. Louie, Fremont, CA (US); Eric Boerwinkle, Houston, TX (US)

(73) Assignee: Celera Corporation, Alameda, CA (US)

(*) Notice: Subject to any disclaimer, the term of this patent is extended or adjusted under 35 U.S.C. 154(b) by 407 days.

(21) Appl. No.: 12/500,378

(22) Filed: Jul. 9, 2009

(65) Prior Publication Data

US 2010/0035983 A1 Feb. 11, 2010

Related U.S. Application Data

(60) Provisional application No. 61/134,522, filed on Jul. 9, 2008.

(51) Int. Cl.
*C12Q 1/68* (2006.01)
*C07H 21/04* (2006.01)

(52) U.S. Cl. ............ 435/6.11; 435/6.12; 536/24.3

(58) Field of Classification Search .......... None
See application file for complete search history.

(56) References Cited

U.S. PATENT DOCUMENTS

| | | | |
|---|---|---|---|
| 2005/0196794 A1 | 9/2005 | Nurnberg et al. | |
| 2005/0272054 A1 | 12/2005 | Cargill et al. | |

OTHER PUBLICATIONS

GenBank GI 34367938 [online] Jan. 20, 2005 [retrieved on Feb. 23, 2012] retrieved from: http://www.ncbi.nlm.nih.gov/nuccore/34367938.*
Erdmann et al. Genome-wide association study identifies a new locus for coronary artery disease on chromosome 10p11.23. European Heart Journal 32:158-168 (2011).*
Luke, M., et al., "A Polymorphism in the Protease-Like Domain of Apolioprotein(a) is Associated with Severe Coronary Artery Disease", Arteriosclerosis, Thrombosis and Vascular Biology, 2007, vol. 27, pp. 2030-2036.
Invitation to Pay Additional Fees issued in PCT/US09/50174, dated Sep. 23, 2009.
Luke, M., et al., "A Polymorphism in the Protease-Like Domain of Apolipoprotein(a) is Associated with Severe Coronary Artery Disease," Arteriosclerosis, Thrombosis, and Vascular Biology, Sep. 2007, vol. 27, pp. 2030-2036.
International Search Report and Written Opinion, application No. PCT/US09/50174, dated Dec. 14, 2009.
Peden, J., et al., "A Genome-Wide Association Study in Europeans and South Asians Identifies Five New Loci for Coronary Artery Disease", Nature Genetics, Published Online on Mar. 6, 2011, 22 pgs.

* cited by examiner

*Primary Examiner* — Samuel Woolwine
(74) *Attorney, Agent, or Firm* — Celera Corporation

(57) ABSTRACT

The present invention provides compositions and methods based on genetic polymorphisms that are associated with cardiovascular diseases, particularly coronary heart disease (especially myocardial infarction) or hypertension. For example, the present invention relates to nucleic acid molecules containing the polymorphisms, variant proteins encoded by these nucleic acid molecules, reagents for detecting the polymorphic nucleic acid molecules and variant proteins, and methods of using the nucleic acid molecules and proteins as well as methods of using reagents for their detection.

30 Claims, No Drawings

GENETIC POLYMORPHISMS ASSOCIATED WITH CARDIOVASCULAR DISEASES, METHODS OF DETECTION AND USES THEREOF

FIELD OF THE INVENTION

The present invention is in the field of cardiovascular diseases (CVD), particularly coronary heart disease (CHD), including myocardial infarction (MI), and hypertension. In particular, the present invention relates to specific single nucleotide polymorphisms (SNPs) in the human genome, and their association with CVD. The SNPs disclosed herein can be used as targets for the design of diagnostic reagents and the development of therapeutic agents, as well as for disease association and linkage analysis. In particular, the SNPs of the present invention are useful for such uses as identifying an individual who has an increased or decreased risk of developing CVD (particularly CHD, such as MI, and hypertension), for early detection of the disease, for providing clinically important information for the prevention and/or treatment of CVD, for predicting progression or recurrence of CVD, for predicting the seriousness or consequences of CVD in an individual, for determining the prognosis of an individual's recovery from CVD, for screening and selecting therapeutic agents, and for predicting a patient's response to therapeutic agents such as evaluating the likelihood of an individual responding positively to a therapeutic agent such as a statin, particularly for the treatment or prevention of CVD (such as CHD, particularly MI, and hypertension). The SNPs disclosed herein are also useful for human identification applications. Methods, assays, kits, and reagents for detecting the presence of these polymorphisms and their encoded products are provided.

BACKGROUND OF THE INVENTION

Cardiovascular Diseases (CVD)

Cardiovascular diseases (CVD) include, for example, coronary heart disease (CHD) and hypertension. CHD includes, for example, myocardial infarction (MI).

Coronary Heart Disease (CHD), Including Myocardial Infarction (MI)

The present invention relates to SNPs that are associated with the occurrence of coronary heart disease (CHD), particularly myocardial infarction (MI).

CHD is defined in the Framingham Heart Study as encompassing MI, angina pectoris, coronary insufficiency (which is manifested as ischemia, that is, impaired oxygen flow to the heart muscle), and coronary heart disease death (Wilson et al., *Circulation* 97:1837-1847 (1998)). CHD may be recorded through clinical records that indicate the following interventions: coronary artery bypass graft (CABG), angioplasty (e.g., percutaneous transluminal coronary angioplasty (PTCA)), and revascularization (stent placement), in addition to clinical records of MI, angina, or coronary death.

As used herein, CHD is defined in accordance with how this term is defined in the Framingham Heart Study (i.e., as encompassing MI, angina pectoris, coronary insufficiency, and coronary heart disease death). Angina pectoris includes unstable angina in particular.

The SNPs described herein may further be useful for such cardiovascular events as vulnerable plaque and stroke.

Myocardial Infarction (MI)

Myocardial infarction (MI), also referred to as a "heart attack", is the most common cause of mortality in developed countries. The incidence of MI is still high despite currently available preventive measures and therapeutic intervention. More than 1,500,000 people in the U.S. suffer acute MI each year, many without seeking help due to unrecognized MI, and one third of these people die. The lifetime risk of coronary artery disease events at age 40 is 42.4% for men, nearly one in two, and 24.9% for women, or one in four. D. M. Lloyd-Jones, *Lancet* 353:89-92 (1999).

MI is a multifactorial disease that involves atherogenesis, thrombus formation and propagation. Thrombosis can result in complete or partial occlusion of coronary arteries. The luminal narrowing or blockage of coronary arteries reduces oxygen and nutrient supply to the cardiac muscle (cardiac ischemia), leading to myocardial necrosis and/or stunning. MI, unstable angina, and sudden ischemic death are clinical manifestations of cardiac muscle damage. All three endpoints are part of acute coronary syndrome since the underlying mechanisms of acute complications of atherosclerosis are considered to be the same.

Atherogenesis, the first step of pathogenesis of MI, is a complex interaction between blood elements, mechanical forces, disturbed blood flow, and vessel wall abnormality that results in plaque accumulation. An unstable (vulnerable) plaque was recognized as an underlying cause of arterial thrombotic events and MI. A vulnerable plaque is a plaque, often not stenotic, that has a high likelihood of becoming disrupted or eroded, thus forming a thrombogenic focus. MI due to a vulnerable plaque is a complex phenomenon that includes: plaque vulnerability, blood vulnerability (hypercoagulation, hypothrombolysis), and heart vulnerability (sensitivity of the heart to ischemia or propensity for arrhythmia). Recurrent myocardial infarction (RMI) can generally be viewed as a severe form of MI progression caused by multiple vulnerable plaques that are able to undergo pre-rupture or a pre-erosive state, coupled with extreme blood coagulability.

The current diagnosis of MI is based on the levels of troponin I or T that indicate the cardiac muscle progressive necrosis, impaired electrocardiogram (ECG), and detection of abnormal ventricular wall motion or angiographic data (the presence of acute thrombi). However, due to the asymptomatic nature of 25% of acute MIs (absence of atypical chest pain, low ECG sensitivity), a significant portion of MIs are not diagnosed and therefore not treated appropriately (e.g., prevention of recurrent MIs).

MI risk assessment and prognosis is currently done using classic risk factors or the recently introduced Framingham Risk Index. Both of these assessments put a significant weight on LDL levels to justify preventive treatment. However, it is well established that half of all MIs occur in individuals without overt hyperlipidemia.

Other emerging risk factors of MI are inflammatory biomarkers such as C-reactive protein (CRP), ICAM-1, SAA, TNF α, homocysteine, impaired fasting glucose, new lipid markers (ox LDL, Lp-a, MAD-LDL, etc.) and pro-thrombotic factors (fibrinogen, PAI-1). These markers have significant limitations such as low specificity and low positive predictive value, and the need for multiple reference intervals to be used for different groups of people (e.g., males-females, smokers-non smokers, hormone replacement therapy users, different age groups). These limitations diminish the utility of such markers as independent prognostic markers for MI screening.

Genetics plays an important role in MI risk. Families with a positive family history of MI account for 14% of the general population, 72% of premature MIs, and 48% of all MIs. R. R. Williams, *Am J Cardiology* 87:129 (2001). In addition, replicated linkage studies have revealed evidence of multiple regions of the genome that are associated with MI and relevant to MI genetic traits, including regions on chromosomes 14, 2, 3 and 7, implying that genetic risk factors influence the onset, manifestation, and progression of MI. U. Broeckel, *Nature Genetics* 30:210 (2002); S. Harrap, *Arterioscler Thromb Vasc Biol* 22:874-878 (2002); A. Shearman, *Human Molecular Genetics* 9:1315-1320 (2000). Recent association studies have identified allelic variants that are associated with acute complications of CHD, including allelic variants of the ApoE, ApoA5, Lpa, APOCIII, and Klotho genes.

Genetic markers such as single nucleotide polymorphisms (SNPs) are preferable to other types of biomarkers. Genetic markers that are prognostic for MI can be genotyped early in life and could predict individual response to various risk factors. The combination of serum protein levels and genetic predisposition revealed by genetic analysis of susceptibility genes can provide an integrated assessment of the interaction between genotypes and environmental factors, resulting in synergistically increased prognostic value of diagnostic tests.

Thus, there is an urgent need for novel genetic markers that are predictive of predisposition to CHD such as MI, particularly for individuals who are unrecognized as having a predisposition to MI. Such genetic markers may enable prognosis of MI in much larger populations compared with the populations that can currently be evaluated by using existing risk factors and biomarkers. The availability of a genetic test may allow, for example, appropriate preventive treatments for acute coronary events to be provided for susceptible individuals (such preventive treatments may include, for example, statin treatments and statin dose escalation, as well as changes to modifiable risk factors), lowering of the thresholds for ECG and angiography testing, and allow adequate monitoring of informative biomarkers. Moreover, the discovery of genetic markers associated with MI will provide novel targets for therapeutic intervention or preventive treatments of MI, and enable the development of new therapeutic agents for treating or preventing MI and other cardiovascular disorders.

Furthermore, novel genetic markers that are predictive of predisposition to MI can be particularly useful for identifying individuals who are at risk for early-onset MI. "Early-onset MI" may be defined as MI in men who are less than 55 years of age and women who are less than 65 years of age. K. O. Akosah et al., "Preventing myocardial infarction in the young adult in the first place: How do the National Cholesterol Education Panel III guidelines perform?" *JACC* 41 (9):1475-1479 (2003). Individuals who experience early-onset MI may not be effectively identified by current cholesterol treatment guidelines, such as those suggested by the National Cholesterol Education Program. In one study, for example, a significant number of individuals who suffered MI at an earlier age ($\leq$50 years) were shown to have LDL cholesterol below 100 mg/dl. K. O. Akosah et al., "Myocardial infarction in young adults with low-density lipoprotein cholesterol levels less than or equal to 100 mg/dl. Clinical profile and 1-year outcomes." *Chest* 120:1953-1958 (2001). Because risk for MI can be reduced by lifestyle changes and by treatment of modifiable risk factors, better methods to identify individuals at risk for early-onset MI could be useful for making preventive treatment decisions, especially considering that these patients may not be identified for medical management by conventional treatment guidelines. Genetic markers for risk of early-onset MI could potentially be incorporated into individual risk assessment protocols, as they have the advantage of being easily detected at any age.

Hypertension

Hypertension is a significant, modifiable risk factor for both CHD and stroke; two of the top three causes of mortality in the United States (Kearney et al., *Lancet*. 2005; 365:217-223; and Centers for Disease Control and Prevention, National Center for Health Statistics, FastStats). The prevalence of hypertension in US adults is estimated to be 29% (Ostchega et al., 2008, National Center for Health Statistics data brief no. 3), and the prevalence is expected to increase in the future (Kearney et al., *Lancet*. 2005; 365:217-223; and Hajjar et al., *JAMA*. 2003; 290:199-206). While about 5% of hypertension has known causes (classified as secondary hypertension), the majority of hypertension is due to unknown causes (classified as essential hypertension) (Cowley et al., *Nature Reviews Genetics*. 2006; 7:829-840). It is estimated that genetic variation contributes to between 30-60% of inter-individual blood pressure variation (Binder, *Curr Opin Cardiol*. 2007; 22: 176-184) but the identity and nature of the contributing genetic loci are largely unknown.

Statin Treatment

HMG-CoA reductase inhibitors (statins) are used for the treatment and prevention of CVD, particularly MI. Reduction of MI and other coronary events and total mortality by treatment with HMG-CoA reductase inhibitors has been demonstrated in a number of randomized, double-blinded, placebo-controlled prospective trials. D. D. Waters, *Clin Cardiol* 24 (8 Suppl):III3-7 (2001); B. K. Singh and J. L. Mehta, *Curr Opin Cardiol* 17 (5):503-11 (2002). These drugs have their primary effect through the inhibition of hepatic cholesterol synthesis, thereby upregulating LDL receptors in the liver. The resultant increase in LDL catabolism results in decreased circulating LDL, a major risk factor for cardiovascular disease.

Statins can be divided into two types according to their physicochemical and pharmacokinetic properties. Statins such as lovastatin, simvastatin, atorvastatin, and cerevastatin are lipophilic in nature and, as such, diffuse across membranes and thus are highly cell permeable. Hydrophilic statins such as pravastatin are more polar, such that they require specific cell surface transporters for cellular uptake. K. Ziegler and W. Stunkel, *Biochim Biophys Acta* 1139 (3):203-9 (1992); M. Yamazaki et al., *Am J Physiol* 264 (1 Pt 1):G36-44 (1993); T. Komai et al., *Biochem Pharmacol* 43 (4):667-70 (1992). The latter statin utilizes a transporter, OATP2, whose tissue distribution is confined to the liver and, therefore, they are relatively hepato-specific inhibitors. B. Hsiang et al., *J Biol Chem* 274 (52):37161-37168 (1999). The former statins, not requiring specific transport mechanisms, are available to all cells and they can directly impact a much broader spectrum of cells and tissues. These differences in properties may influence the spectrum of activities that each statin possesses. Pravastatin, for instance, has a low myopathic potential in animal models and myocyte cultures compared to lipophilic statins. B. A. Masters et al., *Toxicol Appl Pharmacol* 131 (1): 163-174 (1995); K. Nakahara et al., *Toxicol Appl Pharmacol* 152 (1):99-106 (1998); J. C. Reijneveld et al., *Pediatr Res* 39 (6):1028-1035 (1996).

Evidence from gene association studies is accumulating to indicate that responses to drugs are, indeed, at least partly under genetic control. As such, pharmacogenetics—the study of variability in drug responses attributed to hereditary factors in different populations—may significantly assist in providing answers toward meeting this challenge. A. D. Roses, *Nature* 405 (6788):857-865 (2000); V. Mooser et al., *J Thromb Haemost* 1 (7):1398-1402 (2003); L. M. Humma and S. G. Terra, *Am J Health Syst Pharm* 59 (13):1241-1252 (2002). Numerous associations have been reported between selected genotypes, as defined by SNPs and other genetic sequence variations, and specific responses to cardiovascular drugs. Polymorphisms in several genes have been suggested to influence responses to statins including CETP (J. A. Kuivenhoven et al., *N Engl J Med* 338 (2):86-93 (1998)), beta-fibrinogen (M. P. de Maat et al., *Arterioscler Thromb Vasc Biol* 18 (2):265-71 (1998)), hepatic lipase (A. Zambon et al., *Circulation* 103 (6):792-798 (2001)), lipoprotein lipase (J. W. Jukema et al., *Circulation* 94 (8):1913-1918 (1996)), glycoprotein IIIa (P. F. Bray et al., *Am J Cardiol* 88 (4):347-352 (2001)), stromelysin-1 (M. P. de Maat et al., *Am J Cardiol* 83 (6):852-856 (1999)), and apolipoprotein E (L. U. Gerdes et al., *Circulation* 101 (12):1366-1371 (2000); J. Pedro-Botet et al., *Atherosclerosis* 158 (1):183-193 (2001)). Some of these variants were shown to effect clinical events while others were associated with changes in surrogate endpoints.

Thus, there is a need for genetic markers that can be used to predict an individual's responsiveness to statins. For example, there is a growing need to better identify people who have the highest chance of benefiting from statins, and those who have the lowest risk of developing side-effects. For example, severe myopathies represent a significant risk for a low percentage of the patient population, and this may be a particular concern for patients who are treated more aggressively with statins.

Single Nucleotide Polymorphisms (SNPs)

The genomes of all organisms undergo spontaneous mutation in the course of their continuing evolution, generating variant forms of progenitor genetic sequences. Gusella, *Ann Rev Biochem* 55:831-854 (1986). A variant form may confer an evolutionary advantage or disadvantage relative to a progenitor form or may be neutral. In some instances, a variant form confers an evolutionary advantage to the species and is eventually incorporated into the DNA of many or most members of the species and effectively becomes the progenitor form. Additionally, the effects of a variant form may be both beneficial and detrimental, depending on the circumstances. For example, a heterozygous sickle cell mutation confers resistance to malaria, but a homozygous sickle cell mutation is usually lethal. In many cases, both progenitor and variant forms survive and co-exist in a species population. The coexistence of multiple forms of a genetic sequence gives rise to genetic polymorphisms, including SNPs.

Approximately 90% of all genetic polymorphisms in the human genome are SNPs. SNPs are single base positions in DNA at which different alleles, or alternative nucleotides, exist in a population. The SNP position (interchangeably referred to herein as SNP, SNP site, SNP locus, SNP marker, or marker) is usually preceded by and followed by highly conserved sequences of the allele (e.g., sequences that vary in less than $1/100$ or $1/1000$ members of the populations). An individual may be homozygous or heterozygous for an allele at each SNP position. A SNP can, in some instances, be referred to as a "cSNP" to denote that the nucleotide sequence containing the SNP is an amino acid coding sequence.

A SNP may arise from a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion or deletion variant referred to as an "indel." Weber et al., "Human diallelic insertion/deletion polymorphisms," *Am J Hum Genet* 71 (4):854-62 (October 2002).

A synonymous codon change, or silent mutation/SNP (terms such as "SNP," "polymorphism," "mutation," "mutant," "variation," and "variant" are used herein interchangeably), is one that does not result in a change of amino acid due to the degeneracy of the genetic code. A substitution that changes a codon coding for one amino acid to a codon coding for a different amino acid (i.e., a non-synonymous codon change) is referred to as a missense mutation. A nonsense mutation results in a type of non-synonymous codon change in which a stop codon is formed, thereby leading to premature termination of a polypeptide chain and a truncated protein. A read-through mutation is another type of non-synonymous codon change that causes the destruction of a stop codon, thereby resulting in an extended polypeptide product. While SNPs can be bi-, tri-, or tetra-allelic, the vast majority of the SNPs are bi-allelic, and are thus often referred to as "bi-allelic markers," or "di-allelic markers."

As used herein, references to SNPs and SNP genotypes include individual SNPs and/or haplotypes, which are groups of SNPs that are generally inherited together. Haplotypes can have stronger correlations with diseases or other phenotypic effects compared with individual SNPs, and therefore may provide increased diagnostic accuracy in some cases. Stephens et al., *Science* 293:489-493 (July 2001).

Causative SNPs are those SNPs that produce alterations in gene expression or in the expression, structure, and/or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a SNP within a coding sequence causes a genetic disease include sickle cell anemia and cystic fibrosis.

Causative SNPs do not necessarily have to occur in coding regions; causative SNPs can occur in, for example, any genetic region that can ultimately affect the expression, structure, and/or activity of the protein encoded by a nucleic acid. Such genetic regions include, for example, those involved in transcription, such as SNPs in transcription factor binding domains, SNPs in promoter regions, in areas involved in transcript processing, such as SNPs at intron-exon boundaries that may cause defective splicing, or SNPs in mRNA processing signal sequences such as polyadenylation signal regions. Some SNPs that are not causative SNPs nevertheless are in close association with, and therefore segregate with, a disease-causing sequence. In this situation, the presence of a SNP correlates with the presence of, or predisposition to, or an increased risk in developing the disease. These SNPs, although not causative, are nonetheless also useful for diagnostics, disease predisposition screening, and other uses.

An association study of a SNP and a specific disorder involves determining the presence or frequency of the SNP allele in biological samples from individuals with the disorder of interest, such as CVD, and comparing the information to that of controls (i.e., individuals who do not have the disorder; controls may be also referred to as "healthy" or "normal" individuals) who are preferably of similar age and race. The appropriate selection of patients and controls is important to the success of SNP association studies. Therefore, a pool of individuals with well-characterized phenotypes is extremely desirable.

A SNP may be screened in diseased tissue samples or any biological sample obtained from a diseased individual, and compared to control samples, and selected for its increased (or decreased) occurrence in a specific pathological condition, such as pathologies related to CVD and in particular, CHD (particularly MI) and hypertension. Once a statistically significant association is established between one or more SNP(s) and a pathological condition (or other phenotype) of interest, then the region around the SNP can optionally be thoroughly screened to identify the causative genetic locus/sequence(s) (e.g., causative SNP/mutation, gene, regulatory region, etc.) that influences the pathological condition or phenotype. Association studies may be conducted within the general population and are not limited to studies performed on related individuals in affected families (linkage studies).

Clinical trials have shown that patient response to treatment with pharmaceuticals is often heterogeneous. There is a continuing need to improve pharmaceutical agent design and therapy. In that regard, SNPs can be used to identify patients most suited to therapy with particular pharmaceutical agents (this is often termed "pharmacogenomics"). Similarly, SNPs can be used to exclude patients from certain treatment due to the patient's increased likelihood of developing toxic side effects or their likelihood of not responding to the treatment. Pharmacogenomics can also be used in pharmaceutical research to assist the drug development and selection process. Linder et al., *Clinical Chemistry* 43:254 (1997); Marshall, *Nature Biotechnology* 15:1249 (1997); International Patent Application WO 97/40462, Spectra Biomedical; and Schafer et al., *Nature Biotechnology* 16:3 (1998).

SUMMARY OF THE INVENTION

The present invention relates to the identification of SNPs, as well as unique combinations of such SNPs and haplotypes of SNPs, that are associated with cardiovascular diseases (CVD), particularly coronary heart disease (CHD), especially myocardial infarction (MI), and hypertension. The polymorphisms disclosed herein are directly useful as targets for the design of diagnostic and prognostic reagents and the development of therapeutic and preventive agents for use in the diagnosis, prognosis, treatment, and/or prevention of CVD (particularly CHD, such as MI, and hypertension).

Based on the identification of SNPs associated with CVD (particularly CHD, especially MI, and hypertension), the present invention also provides methods of detecting these variants as well as the design and preparation of detection reagents needed to accomplish this task. The invention specifically provides, for example, SNPs associated with CVD, isolated nucleic acid molecules (including DNA and RNA molecules) containing these SNPs, variant proteins encoded by nucleic acid molecules containing such SNPs, antibodies to the encoded variant proteins, computer-based and data storage systems containing the novel SNP information, methods of detecting these SNPs in a test sample, methods of identifying individuals who have an altered (i.e., increased or decreased) risk of developing CVD (particularly CHD, such as MI, and hypertension), methods for determining the risk of an individual for recurring CVD (e.g., recurrent CHD, particularly recurrent MI, or recurrent hypertension), methods for prognosing the severity or consequences of CVD, methods of treating an individual who has an increased risk for CVD, and methods for identifying individuals (e.g., determining a particular individual's likelihood) who have an altered (i.e., increased or decreased) likelihood of responding to a drug treatment, particularly drug treatment of CVD (e.g., treatment or prevention of CHD, such as MI, or hypertension), based on the presence or absence of one or more particular nucleotides (alleles) at one or more SNP sites disclosed herein or the detection of one or more encoded variant products (e.g., variant mRNA transcripts or variant proteins), methods of identifying individuals who are more or less likely to respond to a treatment such as statin treatment (or more or less likely to experience undesirable side effects from a treatment), methods of screening for compounds useful in the treatment or prevention of a disorder associated with a variant gene/protein, compounds identified by these methods, methods of treating or preventing disorders mediated by a variant gene/protein, methods of using the novel SNPs of the present invention for human identification, etc.

The present invention further provides methods for selecting or formulating a treatment regimen (e.g., methods for determining whether or not to administer a treatment such as a statin to an individual having CVD, or who is at risk for developing CVD in the future, or who has previously had CVD, methods for selecting a particular treatment regimen such as dosage and frequency of administration of a therapeutic agent such as a statin, or a particular form/type of a therapeutic agent such as a particular pharmaceutical formulation or compound, etc.), and methods for determining the likelihood of experiencing toxicity or other undesirable side effects from a treatment, etc. The present invention also provides methods for selecting individuals to whom a therapeutic agent (e.g., a statin) will be administered based on the individual's genotype, and methods for selecting individuals for a clinical trial of a therapeutic agent (e.g., a statin) based on the genotypes of the individuals (e.g., selecting individuals to participate in the trial who are most likely to respond positively to the therapeutic agent and/or excluding individuals from the trial who are unlikely to respond positively to the therapeutic agent based on their SNP genotype(s), or selecting individuals who are unlikely to respond positively to a particular therapeutic agent such as a statin based on their SNP genotype(s) to participate in a clinical trial of another type of drug that may benefit them). The present invention further provides methods for reducing an individual's risk of developing CVD (such as CHD, particularly MI, and hypertension) using a drug treatment (e.g., statin treatment), including preventing recurring CVD (e.g., recurrent CHD, particularly recurrent MI, or recurrent hypertension), when said individual carries one or more SNPs identified herein as being associated with CVD and/or response to statin treatment.

In Tables 1 and 2, the present invention provides gene information, references to the identification of transcript sequences (SEQ ID NOS:1-307), encoded amino acid sequences (SEQ ID NOS:308-614), genomic sequences (SEQ ID NOS:1015-1400), transcript-based context sequences (SEQ ID NOS:615-1014) and genomic-based context sequences (SEQ ID NOS:1401-4006 and 5414) that contain the SNPs of the present invention, and extensive SNP information that includes observed alleles, allele frequencies, populations/ethnic groups in which alleles have been observed, information about the type of SNP and corresponding functional effect, and, for cSNPs, information about the encoded polypeptide product. The actual transcript sequences (SEQ ID NOS:1-307), amino acid sequences (SEQ ID NOS:308-614), genomic sequences (SEQ ID NOS:1015-1400), transcript-based SNP context sequences (SEQ ID NOS:615-1014), and genomic-based SNP context sequences (SEQ ID NOS:1401-4006 and 5414), together with primer sequences (SEQ ID NOS:4007-5413 and 5415-5416) are provided in the Sequence Listing.

In certain exemplary embodiments, the invention provides methods for identifying an individual who has an altered risk for developing CVD, such as CHD (particularly MI) or hypertension (including, for example, a first incidence and/or a recurrence of the disease), in which the method comprises detecting a single nucleotide polymorphism (SNP) in any one of the nucleotide sequences of SEQ ID NOS:1-307, SEQ ID NOS:615-1014, SEQ ID NOS:1015-1400, and SEQ ID NOS:

1401-4006 and 5414 in said individual's nucleic acids, wherein the SNP is specified in Table 1 and/or Table 2, and the presence of the SNP is indicative of an altered risk for CVD in said individual. In certain embodiments, the CVD is CHD (particularly MI) or hypertension. In certain exemplary embodiments of the invention, SNPs that occur naturally in the human genome are provided as isolated nucleic acid molecules. These SNPs are associated with CVD (particular CHD, especially MI, and hypertension) such that they can have a variety of uses in the diagnosis, prognosis, treatment, and/or prevention of CVD and related pathologies. In an alternative embodiment, a nucleic acid of the invention is an amplified polynucleotide, which is produced by amplification of a SNP-containing nucleic acid template. In another embodiment, the invention provides for a variant protein that is encoded by a nucleic acid molecule containing a SNP disclosed herein.

In yet another embodiment of the invention, a reagent for detecting a SNP in the context of its naturally-occurring flanking nucleotide sequences (which can be, e.g., either DNA or mRNA) is provided. In particular, such a reagent may be in the form of, for example, a hybridization probe or an amplification primer that is useful in the specific detection of a SNP of interest. In an alternative embodiment, a protein detection reagent is used to detect a variant protein that is encoded by a nucleic acid molecule containing a SNP disclosed herein. A preferred embodiment of a protein detection reagent is an antibody or an antigen-reactive antibody fragment.

Various embodiments of the invention also provide kits comprising SNP detection reagents, and methods for detecting the SNPs disclosed herein by employing detection reagents. In a specific embodiment, the present invention provides for a method of identifying an individual having an increased or decreased risk of developing CVD (e.g., CHD, particularly MI, or hypertension) by detecting the presence or absence of one or more SNP alleles disclosed herein. In another embodiment, a method for diagnosis of CVD by detecting the presence or absence of one or more SNP alleles disclosed herein is provided. The present invention also provides methods for evaluating whether an individual is likely (or unlikely) to respond to a treatment (e.g., a therapeutic agent such as a statin) by detecting the presence or absence of one or more SNP alleles disclosed herein.

The nucleic acid molecules of the invention can be inserted in an expression vector, such as to produce a variant protein in a host cell. Thus, the present invention also provides for a vector comprising a SNP-containing nucleic acid molecule, genetically-engineered host cells containing the vector, and methods for expressing a recombinant variant protein using such host cells. In another specific embodiment, the host cells, SNP-containing nucleic acid molecules, and/or variant proteins can be used as targets in a method for screening and identifying therapeutic agents or pharmaceutical compounds useful in the treatment or prevention of CVD (particularly CHD, such as MI, or hypertension).

An aspect of this invention is a method for treating or preventing CVD, such as CHD (particularly MI) or hypertension (including, for example, a first occurrence and/or a recurrence of the disease), in a human subject wherein said human subject harbors a SNP, gene, transcript, and/or encoded protein identified in Tables 1 and 2, which method comprises administering to said human subject a therapeutically or prophylactically effective amount of one or more agent(s) counteracting the effects of the disease, such as by inhibiting (or stimulating) the activity of a gene, transcript, and/or encoded protein identified in Tables 1 and 2. In certain exemplary embodiments, the agent(s) comprise a statin.

Another aspect of this invention is a method for identifying an agent useful in therapeutically or prophylactically treating CVD (particularly CHD, such as MI, or hypertension), in a human subject wherein said human subject harbors a SNP, gene, transcript, and/or encoded protein identified in Tables 1 and 2, which method comprises contacting the gene, transcript, or encoded protein with a candidate agent under conditions suitable to allow formation of a binding complex between the gene, transcript, or encoded protein and the candidate agent and detecting the formation of the binding complex, wherein the presence of the complex identifies said agent.

Another aspect of this invention is a method for treating or preventing CVD (such as CHD, particularly MI, or hypertension), in a human subject, in which the method comprises:

(i) determining that said human subject harbors a SNP, gene, transcript, and/or encoded protein identified in Tables 1 and 2, and (ii) administering to said subject a therapeutically or prophylactically effective amount of one or more agents (e.g., one or more statins) counteracting the effects of the disease.

Another aspect of the invention is a method for identifying a human who is likely to benefit from a treatment (e.g., a therapeutic agent, particularly a statin), in which the method comprises detecting an allele of one or more SNPs disclosed herein in said human's nucleic acids, wherein the presence of the allele indicates that said human is likely to benefit from the treatment.

Another aspect of the invention is a method for identifying a human who is likely to benefit from a treatment (e.g., a therapeutic agent, particularly a statin), in which the method comprises detecting an allele of one or more SNPs that are in LD with one or more SNPs disclosed herein in said human's nucleic acids, wherein the presence of the allele of the LD SNP indicates that said human is likely to benefit from the treatment.

Many other uses and advantages of the present invention will be apparent to those skilled in the art upon review of the detailed description of the preferred embodiments herein. Solely for clarity of discussion, the invention is described in the sections below by way of non-limiting examples.

DESCRIPTION OF THE TEXT (ASCII) FILE SUBMITTED ELECTRONICALLY VIA EFS-WEB

The following text (ASCII) files are submitted electronically via EFS-Web as part of the instant application:

1) File SEQLIST_CD26ORD.txt provides the Sequence Listing. The Sequence Listing provides the transcript sequences (SEQ ID NOS:1-307) and protein sequences (SEQ ID NOS:308-614) as referred to in Table 1, and genomic sequences (SEQ ID NOS:1015-1400) as referred to in Table 2, for each CVD-associated gene (or genomic region for intergenic SNPs) that contains one or more SNPs of the present invention. Also provided in the Sequence Listing are context sequences flanking each SNP, including both transcript-based context sequences as referred to in Table 1 (SEQ ID NOS:615-1014) and genomic-based context sequences as referred to in Table 2 (SEQ ID NOS:1401-4006 and 5414). In addition, the Sequence Listing provides the primer sequences from Table 5 (SEQ ID NOS:4007-5413 and 5415-5416). The context sequences generally provide 100 bp upstream (5') and 100 bp downstream (3') of each SNP, with the SNP in the middle of the context sequence, for a total of 200 bp of context sequence surrounding each SNP. File SEQLIST_CD26ORD.txt is 52,636 KB in size, and was created on Jul. 8, 2009.

2) File TABLE1_CD26ORD.txt provides Table 1, which is 477 KB in size, and was created on Jul. 7, 2009.

3) File TABLE2_CD26ORD.txt provides Table 2, which is 1,961 KB in size, and was created on Jul. 8, 2009.

4) File TABLE3_CD26ORD.txt provides Table 3, which is 1 KB in size, and was created on Jul. 6, 2009.

5) File TABLE4_CD26ORD.txt provides Table 4, which is 1 KB in size, and was created on Jul. 6, 2009.

These text files are hereby incorporated by reference pursuant to 37 CFR 1.77(b)(4).

an accession number for the protein (e.g., RefSeq NP number, or a Celera hCP identification number if no RefSeq NP number is available) (Table 1 only), the chromosome number of the chromosome on which the gene is located, an OMIM ("Online Mendelian Inheritance in Man" database, Johns Hopkins University/NCBI) public reference number for the gene, and OMIM information such as alternative gene/protein name(s) and/or symbol(s) in the OMIM entry.

Note that, due to the presence of alternative splice forms, multiple transcript/protein entries may be provided for a single gene entry in Table 1; i.e., for a single Gene Number,

LENGTHY TABLES

The patent contains a lengthy table section. A copy of the table is available in electronic form from the USPTO web site (http://seqdata.uspto.gov/?pageRequest=docDetail&DocID=US08216786B2). An electronic copy of the table will also be available from the USPTO upon request and payment of the fee set forth in 37 CFR 1.19(b)(3).

DESCRIPTION OF TABLE 1 AND TABLE 2

Table 1 and Table 2 (both submitted electronically via EFS-Web) disclose the SNP and associated gene/transcript/protein information of the present invention. For each gene, Table 1 provides a header containing gene, transcript and protein information, followed by a transcript and protein sequence identifier (SEQ ID NO), and then SNP information regarding each SNP found in that gene/transcript including the transcript context sequence. For each gene in Table 2, a header is provided that contains gene and genomic information, followed by a genomic sequence identifier (SEQ ID NO) and then SNP information regarding each SNP found in that gene, including the genomic context sequence.

Note that SNP markers may be included in both Table 1 and Table 2; Table 1 presents the SNPs relative to their transcript sequences and encoded protein sequences, whereas Table 2 presents the SNPs relative to their genomic sequences. In some instances Table 2 may also include, after the last gene sequence, genomic sequences of one or more intergenic regions, as well as SNP context sequences and other SNP information for any SNPs that lie within these intergenic regions. Additionally, in either Table 1 or 2 a "Related Interrogated SNP" may be listed following a SNP which is determined to be in LD with that interrogated SNP according to the given Power value. SNPs can be readily cross-referenced between all Tables based on their Celera hCV (or, in some instances, hDV) identification numbers and/or public rs identification numbers, and to the Sequence Listing based on their corresponding SEQ ID NOs.

The gene/transcript/protein information includes:
a gene number (1 through n, where n=the total number of genes in the Table),
a gene symbol, along with an Entrez gene identification number (Entrez Gene database, National Center for Biotechnology Information (NCBI), National Library of Medicine, National Institutes of Health)
a gene name,
an accession number for the transcript (e.g., RefSeq NM number, or a Celera hCT identification number if no RefSeq NM number is available) (Table 1 only), multiple entries may be provided in series that differ in their transcript/protein information and sequences.

Following the gene/transcript/protein information is a transcript context sequence (Table 1), or a genomic context sequence (Table 2), for each SNP within that gene.

After the last gene sequence, Table 2 may include additional genomic sequences of intergenic regions (in such instances, these sequences are identified as "Intergenic region:" followed by a numerical identification number), as well as SNP context sequences and other SNP information for any SNPs that lie within each intergenic region (such SNPs are identified as "INTERGENIC" for SNP type).

Note that the transcript, protein, and transcript-based SNP context sequences are all provided in the Sequence Listing. The transcript-based SNP context sequences are provided in both Table 1 and also in the Sequence Listing. The genomic and genomic-based SNP context sequences are provided in the Sequence Listing. The genomic-based SNP context sequences are provided in both Table 2 and in the Sequence Listing. SEQ ID NOs are indicated in Table 1 for the transcript-based context sequences (SEQ ID NOS:615-1014); SEQ ID NOs are indicated in Table 2 for the genomic-based context sequences (SEQ ID NOS:1401-4006 and 5414).

The SNP information includes:
Context sequence (taken from the transcript sequence in Table 1, the genomic sequence in Table 2) with the SNP represented by its IUB code, including 100 bp upstream (5') of the SNP position plus 100 bp downstream (3') of the SNP position (the transcript-based SNP context sequences in Table 1 are provided in the Sequence Listing as SEQ ID NOS:615-1014; the genomic-based SNP context sequences in Table 2 are provided in the Sequence Listing as SEQ ID NOS:1401-4006 and 5414).
Celera hCV internal identification number for the SNP (in some instances, an "hDV" number is given instead of an "hCV" number; "hDV68873046" may be interchangeably referred to herein as "hCV29714327").
The corresponding public identification number for the SNP, the rs number.
"SNP Chromosome Position" indicates the nucleotide position of the SNP along the entire sequence of the chromosome as provided in NCBI Genome Build 36.

SNP position (nucleotide position of the SNP within the given transcript sequence (Table 1) or within the given genomic sequence (Table 2)).

"Related Interrogated SNP" is the interrogated SNP with which the listed SNP is in LD at the given value of Power.

SNP source (may include any combination of one or more of the following five codes, depending on which internal sequencing projects and/or public databases the SNP has been observed in: "Applera"=SNP observed during the re-sequencing of genes and regulatory regions of 39 individuals, "Celera"=SNP observed during shotgun sequencing and assembly of the Celera human genome sequence, "Celera Diagnostics"=SNP observed during re-sequencing of nucleic acid samples from individuals who have a disease, "dbSNP"=SNP observed in the dbSNP public database, "HGBASE"=SNP observed in the HGBASE public database, "HGMD"=SNP observed in the Human Gene Mutation Database (HGMD) public database, "HapMap"=SNP observed in the International HapMap Project public database, "CSNP"=SNP observed in an internal Applied Biosystems (Foster City, Calif.) database of coding SNPS (cS-NPs).

Note that multiple "Applera" source entries for a single SNP indicate that the same SNP was covered by multiple overlapping amplification products and the re-sequencing results (e.g., observed allele counts) from each of these amplification products is being provided.

Population/allele/allele count information in the format of [population 1(first_allele,count|second_allele,count)population2(first_allele,count|second_allele,count) total (first_allele,total count|second_allele,total count)]. The information in this field includes populations/ethnic groups in which particular SNP alleles have been observed ("cau"=Caucasian, "his"=Hispanic, "chn"=Chinese, and "afr"=African-American, "jpn"=Japanese, "ind"=Indian, "mex"=Mexican, "ain" "American Indian, "cra"=Celera donor, "no_pop"=no population information available), identified SNP alleles, and observed allele counts (within each population group and total allele counts), where available ["-" in the allele field represents a deletion allele of an insertion/deletion ("indel") polymorphism (in which case the corresponding insertion allele, which may be comprised of one or more nucleotides, is indicated in the allele field on the opposite side of the "|"); "-" in the count field indicates that allele count information is not available]. For certain SNPs from the public dbSNP database, population/ethnic information is indicated as follows (this population information is publicly available in dbSNP): "HISPI"=human individual DNA (anonymized samples) from 23 individuals of self-described HISPANIC heritage; "PAC1"=human individual DNA (anonymized samples) from 24 individuals of self-described PACIFIC RIM heritage; "CAUC1"=human individual DNA (anonymized samples) from 31 individuals of self-described CAUCASIAN heritage; "AFR1"=human individual DNA (anonymized samples) from 24 individuals of self-described AFRICAN/AFRICAN AMERICAN heritage; "P1"=human individual DNA (anonymized samples) from 102 individuals of self-described heritage; "PA130299515"; "SC_12_A"=SANGER 12 DNAs of Asian origin from Corielle cell repositories, 6 of which are male and 6 female; "SC_12_C"=SANGER 12 DNAs of Caucasian origin from Corielle cell repositories from the CEPH/UTAH library, six male and six female; "SC_12_AA"=SANGER 12 DNAs of African-American origin from Corielle cell repositories 6 of which are male and 6 female; "SC_95_C"=SANGER 95 DNAs of Caucasian origin from Corielle cell repositories from the CEPH/UTAH library; and "SC_12_CA"=Caucasians—12 DNAs from Corielle cell repositories that are from the CEPH/UTAH library, six male and six female.

Note that for SNPs of "Applera" SNP source, genes/regulatory regions of 39 individuals (20 Caucasians and 19 African Americans) were re-sequenced and, since each SNP position is represented by two chromosomes in each individual (with the exception of SNPs on X and Y chromosomes in males, for which each SNP position is represented by a single chromosome), up to 78 chromosomes were genotyped for each SNP position. Thus, the sum of the African-American ("afr") allele counts is up to 38, the sum of the Caucasian allele counts ("cau") is up to 40, and the total sum of all allele counts is up to 78.

Note that semicolons separate population/allele/count information corresponding to each indicated SNP source; i.e., if four SNP sources are indicated, such as "Celera," "dbSNP," "HGBASE," and "HGMD," then population/allele/count information is provided in four groups which are separated by semicolons and listed in the same order as the listing of SNP sources, with each population/allele/count information group corresponding to the respective SNP source based on order; thus, in this example, the first population/allele/count information group would correspond to the first listed SNP source (Celera) and the third population/allele/count information group separated by semicolons would correspond to the third listed SNP source (HGBASE); if population/allele/count information is not available for any particular SNP source, then a pair of semicolons is still inserted as a place-holder in order to maintain correspondence between the list of SNP sources and the corresponding listing of population/allele/count information.

SNP type (e.g., location within gene/transcript and/or predicted functional effect) ["MIS-SENSE MUTATION"=SNP causes a change in the encoded amino acid (i.e., a non-synonymous coding SNP); "SILENT MUTATION"=SNP does not cause a change in the encoded amino acid (i.e., a synonymous coding SNP); "STOP CODON MUTATION"=SNP is located in a stop codon; "NONSENSE MUTATION"=SNP creates or destroys a stop codon; "UTR 5"=SNP is located in a 5' UTR of a transcript; "UTR 3"=SNP is located in a 3' UTR of a transcript; "PUTATIVE UTR 5"=SNP is located in a putative 5' UTR; "PUTATIVE UTR 3"=SNP is located in a putative 3' UTR; "DONOR SPLICE SITE"=SNP is located in a donor splice site (5' intron boundary); "ACCEPTOR SPLICE SITE"=SNP is located in an acceptor splice site (3' intron boundary); "CODING REGION"=SNP is located in a protein-coding region of the transcript; "EXON"=SNP is located in an exon; "INTRON"=SNP is located in an intron; "hmCS"=SNP is located in a human-mouse conserved segment; "TFBS"=SNP is located in a transcription factor binding site; "UNKNOWN"=SNP type is not defined; "INTERGENIC"=SNP is intergenic, i.e., outside of any gene boundary].

Protein coding information (Table 1 only), where relevant, in the format of [protein SEQ ID NO, amino acid position, (amino acid-1, codon1) (amino acid-2, codon2)]. The information in this field includes SEQ ID NO of the encoded protein sequence, position of the amino acid residue within the protein identified by the SEQ ID NO that is encoded by the codon containing the SNP, amino acids (represented by one-letter amino acid codes) that are encoded by the alternative SNP alleles (in the case of stop codons, "X" is used for the one-letter amino acid code), and alternative codons containing the alternative SNP nucleotides which encode the amino acid residues (thus, for example, for missense mutation-type SNPs, at least two different amino acids and at least two different codons are generally indicated; for silent mutation-type SNPs, one amino acid and at least two different codons are generally indicated, etc.). In instances where the SNP is located outside of a protein-coding region (e.g., in a UTR region), "None" is indicated following the protein SEQ ID NO.

Note that SNPs can be cross-referenced between any of Tables 1-22 herein based on their hCV and/or rs identification numbers. However, two of the SNPs that are included in the tables may possess two different hCV identification numbers, as follows:

SNP hCV25473098 is the same as SNP hCV16173091 set forth in Tables 1-2.

SNP hCV16192174 is the same as SNP hCV22271999 set forth in Tables 1-2.

SNP hCV25640504 can be represented by either genomic context sequences SEQ ID NOS:2554 or 5414 (each of which is set forth in Table 2 and the Sequence Listing), and can be assayed using either allele-specific primers SEQ ID NOS:4580-4581 or SEQ ID NOS:5415-5416 (any of which can be used in combination with common primer SEQ ID NO:4582) (each of which allele-specific and common primers is set forth in Table 5 and the Sequence Listing).

DESCRIPTION OF TABLE 3 AND TABLE 4

Tables 3 and 4 (both submitted electronically via EFS-Web) provide a list of a subset of SNPs from Table 1 (in the case of Table 3) or Table 2 (in the case of Table 4) for which the SNP source falls into one of the following three categories: 1) SNPs for which the SNP source is only "Applera" and none other, 2) SNPs for which the SNP source is only "Celera Diagnostics" and none other, and 3) SNPs for which the SNP source is both "Applera" and "Celera Diagnostics" but none other.

These SNPs have not been observed in any of the public databases (dbSNP, HGBASE, and HGMD), and were also not observed during shotgun sequencing and assembly of the Celera human genome sequence (i.e., "Celera" SNP source). Tables 3 and 4 provide the hCV identification number (or hDV identification number for SNPs having "Celera Diagnostics" SNP source) and the SEQ ID NO of the context sequence for each of these SNPs.

DESCRIPTION OF TABLE 5

Table 5 provides sequences (SEQ ID NOS:4007-5413 and 5415-5416) of primers that may be used to assay the SNPs disclosed herein by allele-specific PCR or other methods, such as for uses related to CVD.

Table 5 provides the following:

the column labeled "Marker" provides an hCV identification number for each SNP that can be detected using the corresponding primers.

the column labeled "Alleles" designates the two alternative alleles (i.e., nucleotides) at the SNP site. These alleles are targeted by the allele-specific primers (the allele-specific primers are shown as Primer 1 and Primer 2). Note that alleles may be presented in Table 5 based on a different orientation (i.e., the reverse complement) relative to how the same alleles are presented in Tables 1-2.

the column labeled "Primer 1 (Allele-Specific Primer)" provides an allele-specific primer that is specific for an allele designated in the "Alleles" column.

the column labeled "Primer 2 (Allele-Specific Primer)" provides an allele-specific primer that is specific for the other allele designated in the "Alleles" column.

the column labeled "Common Primer" provides a common primer that is used in conjunction with each of the allele-specific primers (i.e., Primer 1 and Primer 2) and which hybridizes at a site away from the SNP position.

All primer sequences are given in the 5' to 3' direction.

Each of the nucleotides designated in the "Alleles" column matches or is the reverse complement of (depending on the orientation of the primer relative to the designated allele) the 3' nucleotide of the allele-specific primer (i.e., either Primer 1 or Primer 2) that is specific for that allele.

DESCRIPTION OF TABLE 6

Table 6 provides a list of LD SNPs that are related to and derived from certain interrogated SNPs. The interrogated SNPs, which are shown in column 1 (which indicates the hCV identification numbers of each interrogated SNP) and column 2 (which indicates the public rs identification numbers of each interrogated SNP) of Table 6, are statistically significantly associated with CVD, as described and shown herein, particularly in Tables 7-22 and in the Examples section below. The LD SNPs are provided as an example of SNPs which can also serve as markers for disease association based on their being in LD with an interrogated SNP. The criteria and process of selecting such LD SNPs, including the calculation of the $r^2$ value and the $r^2$ threshold value, are described in Example 6, below.

In Table 6, the column labeled "Interrogated SNP" presents each marker as identified by its unique hCV identification number. The column labeled "Interrogated rs" presents the publicly known rs identification number for the corresponding hCV number. The column labeled "LD SNP" presents the hCV numbers of the LD SNPs that are derived from their corresponding interrogated SNPs. The column labeled "LD SNP rs" presents the publicly known rs identification number for the corresponding hCV number. The column labeled "Power" presents the level of power where the $r^2$ threshold is set. For example, when power is set at 0.51, the threshold $r^2$ value calculated therefrom is the minimum $r^2$ that an LD SNP must have in reference to an interrogated SNP, in order for the LD SNP to be classified as a marker capable of being associated with a disease phenotype at greater than 51% probability. The column labeled "Threshold $r^2$" presents the minimum value of $r^2$ that an LD SNP must meet in reference to an interrogated SNP in order to qualify as an LD SNP. The column labeled "$r^2$" presents the actual $r^2$ value of the LD SNP in reference to the interrogated SNP to which it is related.

DESCRIPTION OF TABLES 7-22

Tables 7-22 provide the results of statistical analyses for SNPs disclosed in Tables 1 and 2 (SNPs can be cross-referenced between all the tables herein based on their hCV and/or rs identification numbers). The results shown in Tables 7-22 provide support for the association of these SNPs with CVD, particularly CHD (especially MI) and/or hypertension.

Table 7 provides association test results from two MI case-control studies (see Example 1 below).

Table 8 provides descriptive information by race and GOSR2 genotype (see Example 1 below).

Table 9 provides OR and 95% CI for the association between GOSR2 (Lys67Arg, rs197922), hypertension, and carotid artery thickness (see Example 1 below).

Table 10 provides SNPs surrounding GOSR2SNP rs197922 (hCV2275273) that are associated with CVD, particularly CHD, and especially MI (see Example 3 below).

Table 11 provides risk factors for MI in participants of three case-control studies (see Example 2 below).

Table 12 provides twenty-four SNPs associated with MI in Study 1 (UCSF) and Study 2 (UCSF) (see Example 2 below).

Table 13 provides results for genotypic association of five SNPs in Study 3 (CCF) (see Example 2 below).

Table 14 provides SNPs surrounding the ENO1 SNP rs1325920 (hCV8824241) that are associated with CVD, particularly CHD, and especially MI (see Example 3 below).

Table 15 provides SNPs surrounding the FXN SNP rs10890 (hCV1463226) that are associated with CVD, particularly CHD, and especially MI (see Example 3 below).

Table 16 provides SNPs surrounding the RERE SNP rs10779705 (hCV32055477) that are associated with CVD, particularly CHD, and especially MI (see Example 3 below).

Table 17 provides SNPs surrounding VAMP8 rs1010 (hCV2091644) that are associated with CVD, particularly CHD, and especially MI (see Example 3 below).

Tables 18 and 19 provide SNPs surrounding the LPA SNP rs3798220 (hCV25930271) that are associated with CVD, particularly CHD, and especially MI. Table 18 provides results of an analysis of the UCSF1 sample set, and Table 19 provides results of a meta-analysis of the UCSF1 and UCSF2 sample sets combined. The SNPs provided in Table 19 are also associated with Lp(a) levels (see Example 3 below).

Table 20 provides SNPs (from a functional genome scan (FGS)) associated with CVD, particularly CHD, and especially MI, in two studies (see Example 4 below).

Table 21 provides SNPs associated with reduction of CHD risk, particularly risk for MI and recurrent MI, by Pravastatin in the CARE study, and Table 22 provides SNPs associated with risk of CHD, particularly risk for MI and recurrent MI, in the placebo arm of the CARE study. The SNPs provided in Table 22 are a subset of the SNPs provided in Table 21; thus, the SNPs provided in Table 22 are associated with both increased CHD risk as well as reduction of CHD risk by statin treatment (e.g., Pravastatin) (see Example 5 below).

Table 21 provides SNPs for which the effect of pravastatin on the primary endpoint of the CARE study (identified as "endpt1" in the Endpoint column) or the recurrent MI endpoint (identified as "rmi" in the Endpoint column) was analyzed by genotype subgroups and for which pravastatin reduced risk in one genotype subgroup but not in another (P-interaction between statin treatment and genotype for the enpdpoint<0.1).

Table 22 provides a subset of SNPs from Table 21 that were associated (p<0.1) with time to occurrence of first event, either the CARE primary endpoint ("endpt1") or recurrent MI endpoint ("rmi"), in the placebo group of the CARE study. In Table 22, the HR (including lower and upper confidence intervals) and p-values indicated for each SNP correspond to Allele 1 (Allele 2 is the reference allele, which is considered to have HR=1).

In Tables 21-22, the column labeled "Endpoint" indicates whether the endpoint that was analyzed was the primary endpoint of the CARE study (a composite endpoint of fatal coronary event or nonfatal MI, and identified as "endpt1") or a composite endpoint of confirmed fatal or nonfatal MI (identified as "rmi"). Also in Tables 21-22, the column labeled "Events" indicates the number of individuals in the CARE study who had an event (a fatal coronary event or nonfatal MI if "endpt1" is indicated in the Endpoint column, or a fatal or nonfatal MI if "rmi" is indicated in the Endpoint column). Table 22 indicates, for each SNP, the number of individuals in the placebo arm of the CARE study who had an event (column labeled "Events (placebo arm)") and the total number of individuals (column labeled "Total Patients (placebo arm)"). Table 21 indicates, for each SNP, the number of individuals who had an event in each of the Pravastatin and placebo arms of the CARE study (columns labeled "Events (Pravastatin arm)" and "Events (placebo arm)", respectively) and the number of individuals who did not have an event in each of the Pravastatin and placebo arms of the CARE study (columns labeled "Nonevent (Pravastatin arm)" and "Nonevent (placebo arm)", respectively).

Throughout Tables 7-22, with respect to model, "add" is additive, "rec" is recessive, "dom" is dominant, "het" is heterozygotes compared with reference homozygotes, and "hom" is non-reference homozygotes compared with reference homozygotes, and with respect to strata, "M" is males only and "F" is females only.

Throughout Tables 7-22, "OR" refers to the odds ratio, "HR" refers to the hazard ratio, and "90% CI" or "95% CI" refers to the 90% or 95% confidence interval (respectively) for the odds ratio or hazard ratio ("OR95U" and "OR95L" refer to the upper and lower 95% confidence intervals, respectively, for the odds ratio; and "HR95U" and "HR95L" refer to the upper and lower 95% confidence intervals, respectively, for the hazard ratio). Odds ratios (OR) or hazard ratios (HR) that are greater than one indicate that a given allele is a risk allele (which may also be referred to as a susceptibility allele), whereas odds ratios that are less than one indicate that a given allele is a non-risk allele (which may also be referred to as a protective allele). For a given risk allele, the other alternative allele at the SNP position (which can be derived from the information provided in Tables 1-2, for example) may be considered a non-risk allele. For a given non-risk allele, the other alternative allele at the SNP position may be considered a risk allele.

Thus, with respect to disease risk (e.g., CVD such as CHD, particularly MI, or hypertension), if the risk estimate (odds ratio or hazard ratio) for a particular allele at a SNP position is greater than one, this indicates that an individual with this particular allele has a higher risk for the disease than an individual who has the other allele at the SNP position. In contrast, if the risk estimate (odds ratio or hazard ratio) for a particular allele is less than one, this indicates that an individual with this particular allele has a reduced risk for the disease compared with an individual who has the other allele at the SNP position.

With respect to drug response (e.g., response to a statin), if the risk estimate (odds ratio or hazard ratio) of those treated with the drug (e.g., a statin) compared with those treated with a placebo within a particular genotype is less than one, this indicates that an individual with this particular genotype would benefit from the drug (an odds ratio or hazard ratio equal to one would indicate that the drug has no effect). As used herein, the term "benefit" (with respect to a preventive or therapeutic drug treatment) is defined as achieving a reduced risk for a disease that the drug is intended to treat or prevent (e.g., CVD such as CHD, particularly MI, or hypertension) by administering the drug treatment, compared with the risk for the disease in the absence of receiving the drug treatment (or receiving a placebo in lieu of the drug treatment) for the same genotype.

DETAILED DESCRIPTION OF THE INVENTION

The present invention provides SNPs associated with cardiovascular diseases (CVD), particularly coronary heart disease (CHD), especially myocardial infarction (MI), and hypertension. The present invention further provides nucleic acid molecules containing these SNPs, methods and reagents for the detection of the SNPs disclosed herein, uses of these SNPs for the development of detection reagents, and assays or kits that utilize such reagents. The SNPs disclosed herein are useful for diagnosing, prognosing, screening for, and evaluating predisposition to CVD and related pathologies in humans. The SNPs disclosed herein may also be used for predicting, screening for, and evaluating response to a treatment (e.g., a therapeutic agent, particularly a statin), particularly treatment or prevention of CVD, in humans. Furthermore, such SNPs and their encoded products are useful targets for the development of therapeutic and preventive agents.

A large number of SNPs have been identified from re-sequencing DNA from 39 individuals, and they are indicated as "Applera" SNP source in Tables 1-2. Their allele frequencies observed in each of the Caucasian and African-American ethnic groups are provided. Additional SNPs included herein were previously identified during "shotgun" sequencing and assembly of the human genome, and they are indicated as "Celera" SNP source in Tables 1 and 2. Furthermore, the information provided in Tables 1 and 2, particularly the allele frequency information obtained from 39 individuals and the identification of the precise position of each SNP within each gene/transcript, allows haplotypes (i.e., groups of SNPs that are co-inherited) to be readily inferred. The present invention encompasses SNP haplotypes, as well as individual SNPs.

Thus, the present invention provides individual SNPs associated with CVD (particularly CHD, especially MI, and hypertension), as well as combinations of SNPs and haplotypes, polymorphic/variant transcript sequences (SEQ ID NOS:1-307) and genomic sequences (SEQ ID NOS:1015-1400) containing SNPs, encoded amino acid sequences (SEQ ID NOS:308-614), and both transcript-based SNP context sequences (SEQ ID NOS:615-1014) and genomic-based SNP context sequences (SEQ ID NOS:1401-4006 and 5414) (transcript sequences, protein sequences, and transcript-based SNP context sequences are provided in Table 1 and the Sequence Listing; genomic sequences and genomic-based SNP context sequences are provided in Table 2 and the Sequence Listing), methods of detecting these polymorphisms in a test sample, methods of determining the risk of an individual of having or developing CVD, methods of determining if an individual is likely to respond to a particular treatment such as a therapeutic agent such as a statin (particularly for treating or preventing CVD), methods of screening for compounds useful for treating disorders associated with a variant gene/protein such as CVD, compounds identified by these screening methods, methods of using the disclosed SNPs to select a treatment/preventive strategy or therapeutic agent, methods of treating or preventing a disorder associated with a variant gene/protein, and methods of using the SNPs of the present invention for human identification.

The present invention further provides methods for selecting or formulating a treatment regimen (e.g., methods for determining whether or not to administer a therapeutic agent, particularly a statin, to an individual having CVD, or who is at risk for developing CVD in the future, or who has previously had CVD, methods for selecting a particular treatment regimen such as dosage and frequency of administration of a therapeutic agent (e.g., a statin), or a particular form/type of a therapeutic agent such as a particular pharmaceutical formulation or compound, methods for administering an alternative treatment to individuals who are predicted to be unlikely to respond positively to a particular treatment, etc.), and methods for determining the likelihood of experiencing toxicity or other undesirable side effects from a treatment, etc. The present invention also provides methods for selecting individuals to whom a therapeutic agent (e.g., a statin) will be administered based on the individual's genotype, and methods for selecting individuals for a clinical trial of a therapeutic agent (e.g., a statin) based on the genotypes of the individuals (e.g., selecting individuals to participate in the trial who are most likely to respond positively to a therapeutic agent and/or excluding individuals from the trial who are unlikely to respond positively to a therapeutic agent based on their SNP genotype(s), or selecting individuals who are unlikely to respond positively to a particular agent such as a statin based on their SNP genotype(s) to participate in a clinical trial of another therapeutic agent that may benefit them).

The present invention may include novel SNPs associated with CVD and/or statin response, as well as SNPs that were previously known in the art, but were not previously known to be associated with CVD and/or statin response. Accordingly, the present invention may provide novel compositions and methods based on novel SNPs disclosed herein, and may also provide novel methods of using known, but previously unassociated, SNPs in methods relating to, for example, evaluating an individual's likelihood of having or developing CVD (particularly CHD, such as MI, and hypertension), predicting the likelihood of an individual experiencing a recurrence of CVD (e.g., experiencing recurrent CHD, particularly recurrent MI, or recurrent hypertension), prognosing the severity of CVD in an individual, or prognosing an individual's recovery from CVD, and methods relating to evaluating an individual's likelihood of responding to a treatment such as a particular therapeutic agent, especially a statin (particularly for treatment, including preventive treatment, of CVD). In Tables 1 and 2, known SNPs are identified based on the public database in which they have been observed, which is indicated as one or more of the following SNP types: "dbSNP"=SNP observed in dbSNP, "HGBASE"=SNP observed in HGBASE, and "HGMD"=SNP observed in the Human Gene Mutation Database (HGMD).

Particular SNP alleles of the present invention can be associated with either an increased risk of having or developing CVD (e.g., CHD, such as MI, or hypertension) or increased likelihood of responding to a treatment such as a statin (particularly treatment, including preventive treatment, of CVD), or a decreased risk of having or developing CVD or decreased likelihood of responding to a treatment. Thus, whereas certain SNPs (or their encoded products) can be assayed to determine whether an individual possesses a SNP allele that is indicative of an increased risk of having or developing CVD (e.g., CHD, such as MI, or hypertension) or increased likelihood of responding to a treatment, other SNPs (or their encoded products) can be assayed to determine whether an individual possesses a SNP allele that is indicative of a decreased risk of having or developing CVD or decreased likelihood of responding to a treatment. Similarly, particular SNP alleles of the present invention can be associated with either an increased or decreased likelihood of having a recurrence of CVD (e.g., recurrent CHD, particularly recurrent MI, or recurrent hypertension), of fully recovering from CVD, of experiencing toxic effects from a particular treatment or therapeutic compound, etc. The term "altered" may be used herein to encompass either of these two possibilities (e.g., an increased or a decreased risk/likelihood). SNP alleles that are associated with a decreased risk of having or developing CVD (e.g., CHD, such as MI, or hypertension) may be referred to as "protective" alleles, and SNP alleles that are associated with an increased risk of having or developing CVD may be referred to as "susceptibility" alleles, "risk" alleles, or "risk factors".

Those skilled in the art will readily recognize that nucleic acid molecules may be double-stranded molecules and that reference to a particular site on one strand refers, as well, to the corresponding site on a complementary strand. In defining a SNP position, SNP allele, or nucleotide sequence, reference to an adenine, a thymine (uridine), a cytosine, or a guanine at a particular site on one strand of a nucleic acid molecule also defines the thymine (uridine), adenine, guanine, or cytosine (respectively) at the corresponding site on a complementary strand of the nucleic acid molecule. Thus, reference may be made to either strand in order to refer to a particular SNP position, SNP allele, or nucleotide sequence. Probes and primers, may be designed to hybridize to either strand and SNP genotyping methods disclosed herein may generally target either strand. Throughout the specification, in identifying a SNP position, reference is generally made to the protein-encoding strand, only for the purpose of convenience.

References to variant peptides, polypeptides, or proteins of the present invention include peptides, polypeptides, proteins, or fragments thereof, that contain at least one amino acid residue that differs from the corresponding amino acid sequence of the art-known peptide/polypeptide/protein (the art-known protein may be interchangeably referred to as the "wild-type," "reference," or "normal" protein). Such variant peptides/polypeptides/proteins can result from a codon change caused by a nonsynonymous nucleotide substitution at a protein-coding SNP position (i.e., a missense mutation) disclosed by the present invention. Variant peptides/polypeptides/proteins of the present invention can also result from a nonsense mutation (i.e., a SNP that creates a premature stop codon, a SNP that generates a read-through mutation by abolishing a stop codon), or due to any SNP disclosed by the present invention that otherwise alters the structure, function, activity, or expression of a protein, such as a SNP in a regulatory region (e.g. a promoter or enhancer) or a SNP that leads to alternative or defective splicing, such as a SNP in an intron or a SNP at an exon/intron boundary. As used herein, the terms "polypeptide," "peptide," and "protein" are used interchangeably.

As used herein, an "allele" may refer to a nucleotide at a SNP position (wherein at least two alternative nucleotides are present in the population at the SNP position, in accordance with the inherent definition of a SNP) or may refer to an amino acid residue that is encoded by the codon which contains the SNP position (where the alternative nucleotides that are present in the population at the SNP position form alternative codons that encode different amino acid residues). An "allele" may also be referred to herein as a "variant". Also, an amino acid residue that is encoded by a codon containing a particular SNP may simply be referred to as being encoded by the SNP.

A phrase such as "as represented by", "as shown by", "as symbolized by", or "as designated by" may be used herein to refer to a SNP within a sequence (e.g., a polynucleotide context sequence surrounding a SNP), such as in the context of "a polymorphism as represented by position 101 of SEQ ID NO:X or its complement". Typically, the sequence surrounding a SNP may be recited when referring to a SNP, however the sequence is not intended as a structural limitation beyond the specific SNP position itself. Rather, the context sequence is recited merely as a way of referring to the SNP (in this example, "SEQ ID NO:X or its complement" is recited in order to refer to the SNP located at position 101 of SEQ ID NO:X, but SEQ ID NO:X or its complement is not intended as a structural limitation beyond the specific SNP position itself). In other words, it is recognized that the context sequence of SEQ ID NO:X in this example may contain one or more polymorphic nucleotide positions outside of position 101 and therefore an exact match over the full-length of SEQ ID NO:X is irrelevant since SEQ ID NO:X is only meant to provide context for referring to the SNP at position 101 of SEQ ID NO:X. Likewise, the length of the context sequence is also irrelevant (100 nucleotides on each side of a SNP position has been arbitrarily used in the present application as the length for context sequences merely for convenience and because 201 nucleotides of total length is expected to provide sufficient uniqueness to unambiguously identify a given nucleotide sequence). Thus, since a SNP is a variation at a single nucleotide position, it is customary to refer to context sequence (e.g., SEQ ID NO:X in this example) surrounding a particular SNP position in order to uniquely identify and refer to the SNP. Alternatively, a SNP can be referred to by a unique identification number such as a public "rs" identification number or an internal "hCV" identification number, such as provided herein for each SNP (e.g., in Tables 1-2).

As used herein, the term "benefit" (with respect to a preventive or therapeutic drug treatment such as a statin) is defined as achieving a reduced risk for a disease that the drug (e.g., statin) is intended to treat or prevent (e.g., CVD such as CHD, particularly MI, and hypertension) by administrating the drug treatment, compared with the risk for the disease in the absence of receiving the drug treatment (or receiving a placebo in lieu of the drug treatment) for the same genotype. The term "benefit" may be used herein interchangeably with terms such as "respond positively" or "positively respond".

As used herein, the terms "drug" and "therapeutic agent" are used interchangeably, and may include, but are not limited to, small molecule compounds, biologics (e.g., antibodies, proteins, protein fragments, fusion proteins, glycoproteins, etc.), nucleic acid agents (e.g., antisense, RNAi/siRNA, and microRNA molecules, etc.), vaccines, etc., which may be used for therapeutic and/or preventive treatment of a disease (e.g., CVD such as CHD, particularly MI, or hypertension).

As used herein, a "drug", "therapeutic agent", or "treatment", may include any agent used in the treatment (including therapeutic or preventive treatment) of CVD, particularly CHD (e.g., MI) or hypertension, such as, for example, a statin such as pravastatin (Pravachol®), atorvastatin (Lipitor®), fluvastatin (Lescol®), lovastatin (Mevacor®), rosuvastatin (Crestor®), simvastatin (Zocor®), and storvastatin, as well as combination therapies that include a statin such as simvastatin+ezetimibe (Vytorin®), lovastatin+niacin extended-release (Advicor®), and atorvastatin+amlodipine besylate (Caduet®).

Hormone Replacement Therapy (HRT)

Certain aspects of the invention relate to methods of using SNP rs3798220 (which is also referred to herein as hCV25930271) for utilities related to hormone replacement therapy (HRT), particularly methods that relate to carriers of the rs3798220 risk allele (C) benefiting from hormone replacement therapy.

SNP rs3798220, which is in the LPA gene, is associated with risk of CVD, particularly MI (as described herein, particularly in Example 2 below; also see Luke et al. *ATVB* 2007; 27:2030-2036, which is incorporated herein by reference in its entirety). SNP rs3798220 is also associated with Lp(a) levels. Shilpak et al. (*JAMA*. 2000; 283:1845) have shown in the HERS study that women in the hormone replacement therapy (estrogen+progestin treatment) group with high baseline Lp(a) have significant reduction of cardiovascular events compared with placebo. About 70% of carriers of the rs3798220 risk allele (C) have very high Lp(a) levels.

Accordingly, certain exemplary embodiments of the invention provide methods of using SNP rs3798220 (hCV25930271) for utilities related to HRT, such as methods of determining whether an individual will benefit from HRT based on which allele the individual possesses at SNP rs3798220 (e.g., if an individual possesses the rs3798220 risk allele (C), then that individual would be identified as an individual who would benefit from HRT), methods of determining an individual's risk for CVD (particularly cardiovascular events such as MI) following HRT based on which allele the individual possesses at SNP rs3798220 (e.g., if an individual possesses the rs3798220 risk allele (C), then that individual would be identified as an individual who would have a reduced risk for cardiovascular events such as MI following HRT as compared to the individual's risk for cardiovascular events in the absence of HRT (e.g., as compared with placebo)), and methods of treating an individual with HRT based on having identified that individual as someone who would be predicted to benefit from HRT (e.g., have a reduced risk for CVD, particularly cardiovascular events such as MI, following HRT) based on which allele they possess at SNP rs3798220 (e.g., if an individual possesses the rs3798220 risk allele (C), then that individual would be treated with HRT, since it would therefore be predicted that the individual would benefit from HRT), as well as other related methods.

Reports, Programmed Computers, Business Methods, and Systems

The results of a test (e.g., an individual's risk for CVD such as CHD, particularly MI, or hypertension), or an individual's predicted drug responsiveness (e.g., response to statin treatment), based on assaying one or more SNPs disclosed herein, and/or an individual's allele(s)/genotype at one or more SNPs disclosed herein, etc.), and/or any other information pertaining to a test, may be referred to herein as a "report". A tangible report can optionally be generated as part of a testing process (which may be interchangeably referred to herein as "reporting", or as "providing" a report, "producing" a report, or "generating" a report).

Examples of tangible reports may include, but are not limited to, reports in paper (such as computer-generated printouts of test results) or equivalent formats and reports stored on computer readable medium (such as a CD, USB flash drive or other removable storage device, computer hard drive, or computer network server, etc.). Reports, particularly those stored on computer readable medium, can be part of a database, which may optionally be accessible via the internet (such as a database of patient records or genetic information stored on a computer network server, which may be a "secure database" that has security features that limit access to the report, such as to allow only the patient and the patient's medical practioners to view the report while preventing other unauthorized individuals from viewing the report, for example). In addition to, or as an alternative to, generating a tangible report, reports can also be displayed on a computer screen (or the display of another electronic device or instrument).

A report can include, for example, an individual's risk for CVD, such as CHD (e.g., MI) or hypertension, or may just include the allele(s)/genotype that an individual carries at one or more SNPs disclosed herein, which may optionally be linked to information regarding the significance of having the allele(s)/genotype at the SNP (for example, a report on computer readable medium such as a network server may include hyperlink(s) to one or more journal publications or websites that describe the medical/biological implications, such as increased or decreased disease risk, for individuals having a certain allele/genotype at the SNP). Thus, for example, the report can include disease risk or other medical/biological significance (e.g., drug responsiveness, etc.) as well as optionally also including the allele/genotype information, or the report may just include allele/genotype information without including disease risk or other medical/biological significance (such that an individual viewing the report can use the allele/genotype information to determine the associated disease risk or other medical/biological significance from a source outside of the report itself, such as from a medical practioner, publication, website, etc., which may optionally be linked to the report such as by a hyperlink).

A report can further be "transmitted" or "communicated" (these terms may be used herein interchangeably), such as to the individual who was tested, a medical practitioner (e.g., a doctor, nurse, clinical laboratory practitioner, genetic counselor, etc.), a healthcare organization, a clinical laboratory, and/or any other party or requester intended to view or possess the report. The act of "transmitting" or "communicating" a report can be by any means known in the art, based on the format of the report. Furthermore, "transmitting" or "communicating" a report can include delivering a report ("pushing") and/or retrieving ("pulling") a report. For example, reports can be transmitted/communicated by various means, including being physically transferred between parties (such as for reports in paper format) such as by being physically delivered from one party to another, or by being transmitted electronically or in signal form (e.g., via e-mail or over the internet, by facsimile, and/or by any wired or wireless communication methods known in the art) such as by being retrieved from a database stored on a computer network server, etc.

In certain exemplary embodiments, the invention provides computers (or other apparatus/devices such as biomedical devices or laboratory instrumentation) programmed to carry out the methods described herein. For example, in certain embodiments, the invention provides a computer programmed to receive (i.e., as input) the identity (e.g., the allele(s) or genotype at a SNP) of one or more SNPs disclosed herein and provide (i.e., as output) the disease risk (e.g., an individual's risk for CVD such as CHD, particularly MI, or hypertension) or other result (e.g., disease diagnosis or prognosis, drug responsiveness, etc.) based on the identity of the SNP(s). Such output (e.g., communication of disease risk, disease diagnosis or prognosis, drug responsiveness, etc.) may be, for example, in the form of a report on computer readable medium, printed in paper form, and/or displayed on a computer screen or other display.

In various exemplary embodiments, the invention further provides methods of doing business (with respect to methods of doing business, the terms "individual" and "customer" are used herein interchangeably). For example, exemplary methods of doing business can comprise assaying one or more SNPs disclosed herein and providing a report that includes, for example, a customer's risk for CVD such as CHD, particularly MI, or hypertension (based on which allele(s)/genotype is present at the assayed SNP(s)) and/or that includes the allele(s)/genotype at the assayed SNP(s) which may optionally be linked to information (e.g., journal publications, websites, etc.) pertaining to disease risk or other biological/medical significance such as by means of a hyperlink (the report may be provided, for example, on a computer network server or other computer readable medium that is internet-accessible, and the report may be included in a secure database that allows the customer to access their report while preventing other unauthorized individuals from viewing the report), and optionally transmitting the report. Customers (or another party who is associated with the customer, such as the customer's doctor, for example) can request/order (e.g., purchase) the test online via the internet (or by phone, mail order, at an outlet/store, etc.), for example, and a kit can be sent/delivered (or otherwise provided) to the customer (or another party on behalf of the customer, such as the customer's doctor, for example) for collection of a biological sample from the customer (e.g., a buccal swab for collecting buccal cells), and the customer (or a party who collects the customer's biological sample) can submit their biological samples for assaying (e.g., to a laboratory or party associated with the laboratory such as a party that accepts the customer samples on behalf of the laboratory, a party for whom the laboratory is under the control of (e.g., the laboratory carries out the assays by request of the party or under a contract with the party, for example), and/or a party that receives at least a portion of the customer's payment for the test). The report (e.g., results of the assay including, for example, the customer's disease risk and/or allele(s)/genotype at the assayed SNP(s)) may be provided to the customer by, for example, the laboratory that assays the SNP(s) or a party associated with the laboratory (e.g., a party that receives at least a portion of the customer's payment for the assay, or a party that requests the laboratory to carry out the assays or that contracts with the laboratory for the assays to be carried out) or a doctor or other medical practitioner who is associated with (e.g., employed by or having a consulting or contracting arrangement with) the laboratory or with a party associated with the laboratory, or the report may be provided to a third party (e.g., a doctor, genetic counselor, hospital, etc.) which optionally provides the report to the customer. In further embodiments, the customer may be a doctor or other medical practitioner, or a hospital, laboratory, medical insurance organization, or other medical organization that requests/orders (e.g., purchases) tests for the purposes of having other individuals (e.g., their patients or customers) assayed for one or more SNPs disclosed herein and optionally obtaining a report of the assay results.

In certain exemplary methods of doing business, a kit for collecting a biological sample (e.g., a buccal swab for collecting buccal cells, or other sample collection device) is provided to a medical practitioner (e.g., a physician) which the medical practitioner uses to obtain a sample (e.g., buccal cells, saliva, blood, etc.) from a patient, the sample is then sent to a laboratory (e.g., a CLIA-certified laboratory) or other facility that tests the sample for one or more SNPs disclosed herein (e.g., to determine the genotype of one or more SNPs disclosed herein, such as to determine the patient's risk for CVD such as CHD, particularly MI, or hypertension), and the results of the test (e.g., the patient's genotype at one or more SNPs disclosed herein and/or the patient's disease risk based on their SNP genotype) are provided back to the medical practitioner (and/or directly to the patient and/or to another party such as a hospital, medical insurance company, genetic counselor, etc.) who may then provide or otherwise convey the results to the patient. The results are typically provided in the form of a report, such as described above.

In certain further exemplary methods of doing business, kits for collecting a biological sample from a customer (e.g., a buccal swab for collecting buccal cells, or other sample collection device) are provided (e.g., for sale), such as at an outlet (e.g., a drug store, pharmacy, general merchandise store, or any other desirable outlet), online via the internet, by mail order, etc., whereby customers can obtain (e.g., purchase) the kits, collect their own biological samples, and submit (e.g., send/deliver via mail) their samples to a laboratory (e.g., a CLIA-certified laboratory) or other facility which tests the samples for one or more SNPs disclosed herein (e.g., to determine the genotype of one or more SNPs disclosed herein, such as to determine the customer's risk for CVD such as CHD, particularly MI, or hypertension) and provides the results of the test (e.g., of the customer's genotype at one or more SNPs disclosed herein and/or the customer's disease risk based on their SNP genotype) back to the customer and/or to a third party (e.g., a physician or other medical practitioner, hospital, medical insurance company, genetic counselor, etc.). The results are typically provided in the form of a report, such as described above. If the results of the test are provided to a third party, then this third party may optionally provide another report to the customer based on the results of the test (e.g., the result of the test from the laboratory may provide the customer's genotype at one or more SNPs disclosed herein without disease risk information, and the third party may provide a report of the customer's disease risk based on this genotype result).

Certain further embodiments of the invention provide a system for determining an individual's CVD risk (e.g., risk for CHD, particularly MI, or hypertension), or whether an individual will benefit from statin treatment (or other therapy) in reducing CVD risk. Certain exemplary systems comprise an integrated "loop" in which an individual (or their medical practitioner) requests a determination of such individual's CVD risk (or drug response, such as response to statin treatment, etc.), this determination is carried out by testing a sample from the individual, and then the results of this determination are provided back to the requester. For example, in certain systems, a sample (e.g., buccal cells, saliva, blood, etc.) is obtained from an individual for testing (the sample may be obtained by the individual or, for example, by a medical practitioner), the sample is submitted to a laboratory (or other facility) for testing (e.g., determining the genotype of one or more SNPs disclosed herein), and then the results of the testing are sent to the patient (which optionally can be done by first sending the results to an intermediary, such as a medical practioner, who then provides or otherwise conveys the results to the individual and/or acts on the results), thereby forming an integrated loop system for determining an individual's CVD risk (or drug response, etc.). The portions of the system in which the results are transmitted (e.g., between any of a testing facility, a medical practitioner, and/or the individual) can be carried out by way of electronic or signal transmission (e.g., by computer such as via e-mail or the internet, by providing the results on a website or computer network server which may optionally be a secure database, by phone or fax, or by any other wired or wireless transmission methods known in the art). Optionally, the system can further include a risk reduction component (i.e., a disease management system) as part of the integrated loop (for an example of a disease management system, see U.S. Pat. No. 6,770,029, "Disease management system and method including correlation assessment"). For example, the results of the test can be used to reduce the risk of the disease in the individual who was tested, such as by implementing a preventive therapy regimen (e.g., administration of a drug regimen such as a statin treatment for reducing CVD risk), modifying the individual's diet, increasing exercise, reducing stress, and/or implementing any other physiological or behavioral modifications in the individual with the goal of reducing disease risk. For reducing CVD risk (e.g., risk for CHD, particularly MI, or hypertension), this may include any means used in the art for improving aspects of an individual's health relevant to reducing CVD risk. Thus, in exemplary embodiments, the system is controlled by the individual and/or their medical practioner in that the individual and/or their medical practioner requests the test, receives the test results back, and (optionally) acts on the test results to reduce the individual's disease risk, such as by implementing a disease management system.

The various methods described herein, such as correlating the presence or absence of a polymorphism with an altered (e.g., increased or decreased) risk (or no altered risk) for CVD such as CHD, particularly MI, or hypertension (and/or correlating the presence or absence of a polymorphism with the predicted response of an individual to a drug such as a statin), can be carried out by automated methods such as by using a computer (or other apparatus/devices such as biomedical devices, laboratory instrumentation, or other apparatus/devices having a computer processor) programmed to carry out any of the methods described herein. For example, computer software (which may be interchangeably referred to herein as a computer program) can perform the step of correlating the presence or absence of a polymorphism in an individual with an altered (e.g., increased or decreased) risk (or no altered risk) for CVD (particularly risk for CHD, such as MI, or hypertension) for the individual. Computer software can also perform the step of correlating the presence or absence of a polymorphism in an individual with the predicted response of the individual to a drug such as a statin. Accordingly, certain embodiments of the invention provide a computer (or other apparatus/device) programmed to carry out any of the methods described herein.

Isolated Nucleic Acid Molecules and SNP Detection Reagents & Kits

Tables 1 and 2 provide a variety of information about each SNP of the present invention that is associated with CVD (particularly CHD, especially MI, or hypertension), including the transcript sequences (SEQ ID NOS:1-307), genomic sequences (SEQ ID NOS:1015-1400), and protein sequences (SEQ ID NOS:308-614) of the encoded gene products (with the SNPs indicated by IUB codes in the nucleic acid sequences). In addition, Tables 1 and 2 include SNP context sequences, which generally include 100 nucleotide upstream (5') plus 100 nucleotides downstream (3') of each SNP position (SEQ ID NOS:615-1014 correspond to transcript-based SNP context sequences disclosed in Table 1, and SEQ ID NOS:1401-4006 and 5414 correspond to genomic-based context sequences disclosed in Table 2), the alternative nucleotides (alleles) at each SNP position, and additional information about the variant where relevant, such as SNP type (coding, missense, splice site, UTR, etc.), human populations in which the SNP was observed, observed allele frequencies, information about the encoded protein, etc.

Isolated Nucleic Acid Molecules

The present invention provides isolated nucleic acid molecules that contain one or more SNPs disclosed Table 1 and/or Table 2. Isolated nucleic acid molecules containing one or more SNPs disclosed in at least one of Tables 1 and 2 may be interchangeably referred to throughout the present text as "SNP-containing nucleic acid molecules." Isolated nucleic acid molecules may optionally encode a full-length variant protein or fragment thereof. The isolated nucleic acid molecules of the present invention also include probes and primers (which are described in greater detail below in the section entitled "SNP Detection Reagents"), which may be used for assaying the disclosed SNPs, and isolated full-length genes, transcripts, cDNA molecules, and fragments thereof, which may be used for such purposes as expressing an encoded protein.

As used herein, an "isolated nucleic acid molecule" generally is one that contains a SNP of the present invention or one that hybridizes to such molecule such as a nucleic acid with a complementary sequence, and is separated from most other nucleic acids present in the natural source of the nucleic acid molecule. Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. A nucleic acid molecule can be fused to other coding or regulatory sequences and still be considered "isolated." Nucleic acid molecules present in non-human transgenic animals, which do not naturally occur in the animal, are also considered "isolated." For example, recombinant DNA molecules contained in a vector are considered "isolated." Further examples of "isolated" DNA molecules include recombinant DNA molecules maintained in heterologous host cells, and purified (partially or substantially) DNA molecules in solution. Isolated RNA molecules include in vivo or in vitro RNA transcripts of the isolated SNP-containing DNA molecules of the present invention. Isolated nucleic acid molecules according to the present invention further include such molecules produced synthetically.

Generally, an isolated SNP-containing nucleic acid molecule comprises one or more SNP positions disclosed by the present invention with flanking nucleotide sequences on either side of the SNP positions. A flanking sequence can include nucleotide residues that are naturally associated with the SNP site and/or heterologous nucleotide sequences. Preferably, the flanking sequence is up to about 500, 300, 100, 60, 50, 30, 25, 20, 15, 10, 8, or 4 nucleotides (or any other length in-between) on either side of a SNP position, or as long as the full-length gene or entire protein-coding sequence (or any portion thereof such as an exon), especially if the SNP-containing nucleic acid molecule is to be used to produce a protein or protein fragment.

For full-length genes and entire protein-coding sequences, a SNP flanking sequence can be, for example, up to about 5 KB, 4 KB, 3 KB, 2 KB, 1 KB on either side of the SNP. Furthermore, in such instances the isolated nucleic acid molecule comprises exonic sequences (including protein-coding and/or non-coding exonic sequences), but may also include intronic sequences. Thus, any protein coding sequence may be either contiguous or separated by introns. The important point is that the nucleic acid is isolated from remote and unimportant flanking sequences and is of appropriate length such that it can be subjected to the specific manipulations or uses described herein such as recombinant protein expression, preparation of probes and primers for assaying the SNP position, and other uses specific to the SNP-containing nucleic acid sequences.

An isolated SNP-containing nucleic acid molecule can comprise, for example, a full-length gene or transcript, such as a gene isolated from genomic DNA (e.g., by cloning or PCR amplification), a cDNA molecule, or an mRNA transcript molecule. Polymorphic transcript sequences are referred to in Table 1 and provided in the Sequence Listing (SEQ ID NOS:1-307), and polymorphic genomic sequences are referred to in Table 2 and provided in the Sequence Listing (SEQ ID NOS:1015-1400). Furthermore, fragments of such full-length genes and transcripts that contain one or more SNPs disclosed herein are also encompassed by the present invention, and such fragments may be used, for example, to express any part of a protein, such as a particular functional domain or an antigenic epitope.

Thus, the present invention also encompasses fragments of the nucleic acid sequences as disclosed in Tables 1 and 2 (transcript sequences are referred to in Table 1 as SEQ ID NOS:1-307, genomic sequences are referred to in Table 2 as SEQ ID NOS:1015-1400, transcript-based SNP context sequences are referred to in Table 1 as SEQ ID NOS:615-1014, and genomic-based SNP context sequences are referred to in Table 2 as SEQ ID NOS:1401-4006 and 5414) and their complements. The actual sequences referred to in the tables are provided in the Sequence Listing. A fragment typically comprises a contiguous nucleotide sequence at least about 8 or more nucleotides, more preferably at least about 12 or more nucleotides, and even more preferably at least about 16 or more nucleotides. Furthermore, a fragment could comprise at least about 18, 20, 22, 25, 30, 40, 50, 60, 80, 100, 150, 200, 250 or 500 nucleotides in length (or any other number in between). The length of the fragment will be based on its intended use. For example, the fragment can encode epitope-bearing regions of a variant peptide or regions of a variant peptide that differ from the normal/wild-type protein, or can be useful as a polynucleotide probe or primer. Such fragments can be isolated using the nucleotide sequences provided in Table 1 and/or Table 2 for the synthesis of a polynucleotide probe. A labeled probe can then be used, for example, to screen a cDNA library, genomic DNA library, or mRNA to isolate nucleic acid corresponding to the coding region. Further, primers can be used in amplification reactions, such as for purposes of assaying one or more SNPs sites or for cloning specific regions of a gene.

An isolated nucleic acid molecule of the present invention further encompasses a SNP-containing polynucleotide that is the product of any one of a variety of nucleic acid amplification methods, which are used to increase the copy numbers of a polynucleotide of interest in a nucleic acid sample. Such amplification methods are well known in the art, and they include but are not limited to, polymerase chain reaction (PCR) (U.S. Pat. Nos. 4,683,195 and 4,683,202; *PCR Technology: Principles and Applications for DNA Amplification*, ed. H. A. Erlich, Freeman Press, NY, N.Y. (1992)), ligase chain reaction (LCR) (Wu and Wallace, *Genomics* 4:560 (1989); Landegren et al., *Science* 241:1077 (1988)), strand displacement amplification (SDA) (U.S. Pat. Nos. 5,270,184 and 5,422,252), transcription-mediated amplification (TMA) (U.S. Pat. No. 5,399,491), linked linear amplification (LLA) (U.S. Pat. No. 6,027,923) and the like, and isothermal amplification methods such as nucleic acid sequence based amplification (NASBA) and self-sustained sequence replication (Guatelli et al., *Proc Natl Acad Sci USA* 87:1874 (1990)). Based on such methodologies, a person skilled in the art can readily design primers in any suitable regions 5' and 3' to a SNP disclosed herein. Such primers may be used to amplify DNA of any length so long that it contains the SNP of interest in its sequence.

As used herein, an "amplified polynucleotide" of the invention is a SNP-containing nucleic acid molecule whose amount has been increased at least two fold by any nucleic acid amplification method performed in vitro as compared to its starting amount in a test sample. In other preferred embodiments, an amplified polynucleotide is the result of at least ten fold, fifty fold, one hundred fold, one thousand fold, or even ten thousand fold increase as compared to its starting amount in a test sample. In a typical PCR amplification, a polynucleotide of interest is often amplified at least fifty thousand fold in amount over the unamplified genomic DNA, but the precise amount of amplification needed for an assay depends on the sensitivity of the subsequent detection method used.

Generally, an amplified polynucleotide is at least about 16 nucleotides in length. More typically, an amplified polynucleotide is at least about 20 nucleotides in length. In a preferred embodiment of the invention, an amplified polynucleotide is at least about 30 nucleotides in length. In a more preferred embodiment of the invention, an amplified polynucleotide is at least about 32, 40, 45, 50, or 60 nucleotides in length. In yet another preferred embodiment of the invention, an amplified polynucleotide is at least about 100, 200, 300, 400, or 500 nucleotides in length. While the total length of an amplified polynucleotide of the invention can be as long as an exon, an intron or the entire gene where the SNP of interest resides, an amplified product is typically up to about 1,000 nucleotides in length (although certain amplification methods may generate amplified products greater than 1000 nucleotides in length). More preferably, an amplified polynucleotide is not greater than about 600-700 nucleotides in length. It is understood that irrespective of the length of an amplified polynucleotide, a SNP of interest may be located anywhere along its sequence.

In a specific embodiment of the invention, the amplified product is at least about 201 nucleotides in length, comprises one of the transcript-based context sequences or the genomic-based context sequences shown in Tables 1 and 2. Such a product may have additional sequences on its 5' end or 3' end or both. In another embodiment, the amplified product is about 101 nucleotides in length, and it contains a SNP disclosed herein. Preferably, the SNP is located at the middle of the amplified product (e.g., at position 101 in an amplified product that is 201 nucleotides in length, or at position 51 in an amplified product that is 101 nucleotides in length), or within 1, 2, 3, 4, 5, 6, 7, 8, 9, 10, 12, 15, or 20 nucleotides from the middle of the amplified product. However, as indicated above, the SNP of interest may be located anywhere along the length of the amplified product.

The present invention provides isolated nucleic acid molecules that comprise, consist of, or consist essentially of one or more polynucleotide sequences that contain one or more SNPs disclosed herein, complements thereof, and SNP-containing fragments thereof.

Accordingly, the present invention provides nucleic acid molecules that consist of any of the nucleotide sequences shown in Table 1 and/or Table 2 (transcript sequences are referred to in Table 1 as SEQ ID NOS:1-307, genomic sequences are referred to in Table 2 as SEQ ID NOS:1015-1400, transcript-based SNP context sequences are referred to in Table 1 as SEQ ID NOS:615-1014, and genomic-based SNP context sequences are referred to in Table 2 as SEQ ID NOS:1401-4006 and 5414), or any nucleic acid molecule that encodes any of the variant proteins referred to in Table 1 (SEQ ID NOS:308-614). The actual sequences referred to in the tables are provided in the Sequence Listing. A nucleic acid molecule consists of a nucleotide sequence when the nucleotide sequence is the complete nucleotide sequence of the nucleic acid molecule.

The present invention further provides nucleic acid molecules that consist essentially of any of the nucleotide sequences referred to in Table 1 and/or Table 2 (transcript sequences are referred to in Table 1 as SEQ ID NOS:1-307, genomic sequences are referred to in Table 2 as SEQ ID NOS:1015-1400, transcript-based SNP context sequences are referred to in Table 1 as SEQ ID NOS:615-1014, and genomic-based SNP context sequences are referred to in Table 2 as SEQ ID NOS:1401-4006 and 5414), or any nucleic acid molecule that encodes any of the variant proteins referred to in Table 1 (SEQ ID NOS:308-614). The actual sequences referred to in the tables are provided in the Sequence Listing. A nucleic acid molecule consists essentially of a nucleotide sequence when such a nucleotide sequence is present with only a few additional nucleotide residues in the final nucleic acid molecule.

The present invention further provides nucleic acid molecules that comprise any of the nucleotide sequences shown in Table 1 and/or Table 2 or a SNP-containing fragment thereof (transcript sequences are referred to in Table 1 as SEQ ID NOS:1-307, genomic sequences are referred to in Table 2 as SEQ ID NOS:1015-1400, transcript-based SNP context sequences are referred to in Table 1 as SEQ ID NOS:615-1014, and genomic-based SNP context sequences are referred to in Table 2 as SEQ ID NOS:1401-4006 and 5414), or any nucleic acid molecule that encodes any of the variant proteins provided in Table 1 (SEQ ID NOS:308-614). The actual sequences referred to in the tables are provided in the Sequence Listing. A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleotide residues, such as residues that are naturally associated with it or heterologous nucleotide sequences. Such a nucleic acid molecule can have one to a few additional nucleotides or can comprise many more additional nucleotides. A brief description of how various types of these nucleic acid molecules can be readily made and isolated is provided below, and such techniques are well known to those of ordinary skill in the art. Sambrook and Russell, *Molecular Cloning: A Laboratory Manual*, Cold Spring Harbor Press, N.Y. (2000).

The isolated nucleic acid molecules can encode mature proteins plus additional amino or carboxyl-terminal amino acids or both, or amino acids interior to the mature peptide (when the mature form has more than one peptide chain, for instance). Such sequences may play a role in processing of a protein from precursor to a mature form, facilitate protein trafficking, prolong or shorten protein half-life, or facilitate manipulation of a protein for assay or production. As generally is the case in situ, the additional amino acids may be processed away from the mature protein by cellular enzymes.

Thus, the isolated nucleic acid molecules include, but are not limited to, nucleic acid molecules having a sequence encoding a peptide alone, a sequence encoding a mature peptide and additional coding sequences such as a leader or secretory sequence (e.g., a pre-pro or pro-protein sequence), a sequence encoding a mature peptide with or without additional coding sequences, plus additional non-coding sequences, for example introns and non-coding 5' and 3' sequences such as transcribed but untranslated sequences that play a role in, for example, transcription, mRNA processing (including splicing and polyadenylation signals), ribosome binding, and/or stability of mRNA. In addition, the nucleic acid molecules may be fused to heterologous marker sequences encoding, for example, a peptide that facilitates purification.

Isolated nucleic acid molecules can be in the form of RNA, such as mRNA, or in the form DNA, including cDNA and genomic DNA, which may be obtained, for example, by molecular cloning or produced by chemical synthetic techniques or by a combination thereof. Sambrook and Russell, *Molecular Cloning: A Laboratory Manual*, Cold Spring Harbor Press, N.Y. (2000). Furthermore, isolated nucleic acid molecules, particularly SNP detection reagents such as probes and primers, can also be partially or completely in the form of one or more types of nucleic acid analogs, such as peptide nucleic acid (PNA). U.S. Pat. Nos. 5,539,082; 5,527,675; 5,623,049; and 5,714,331. The nucleic acid, especially DNA, can be double-stranded or single-stranded. Single-stranded nucleic acid can be the coding strand (sense strand) or the complementary non-coding strand (anti-sense strand).

DNA, RNA, or PNA segments can be assembled, for example, from fragments of the human genome (in the case of DNA or RNA) or single nucleotides, short oligonucleotide linkers, or from a series of oligonucleotides, to provide a synthetic nucleic acid molecule. Nucleic acid molecules can be readily synthesized using the sequences provided herein as a reference; oligonucleotide and PNA oligomer synthesis techniques are well known in the art. See, e.g., Corey, "Peptide nucleic acids: expanding the scope of nucleic acid recognition," *Trends Biotechnol* 15 (6):224-9 (June 1997), and Hyrup et al., "Peptide nucleic acids (PNA): synthesis, properties and potential applications," *Bioorg Med Chem* 4 (1):5-23) (January 1996). Furthermore, large-scale automated oligonucleotide/PNA synthesis (including synthesis on an array or bead surface or other solid support) can readily be accomplished using commercially available nucleic acid synthesizers, such as the Applied Biosystems (Foster City, Calif.) 3900 High-Throughput DNA Synthesizer or Expedite 8909 Nucleic Acid Synthesis System, and the sequence information provided herein.

The present invention encompasses nucleic acid analogs that contain modified, synthetic, or non-naturally occurring nucleotides or structural elements or other alternative/modified nucleic acid chemistries known in the art. Such nucleic acid analogs are useful, for example, as detection reagents (e.g., primers/probes) for detecting one or more SNPs identified in Table 1 and/or Table 2. Furthermore, kits/systems (such as beads, arrays, etc.) that include these analogs are also encompassed by the present invention. For example, PNA oligomers that are based on the polymorphic sequences of the present invention are specifically contemplated. PNA oligomers are analogs of DNA in which the phosphate backbone is replaced with a peptide-like backbone. Lagriffoul et al., *Bioorganic & Medicinal Chemistry Letters* 4:1081-1082 (1994); Petersen et al., *Bioorganic & Medicinal Chemistry Letters* 6:793-796 (1996); Kumar et al., *Organic Letters* 3 (9):1269-1272 (2001); WO 96/04000. PNA hybridizes to complementary RNA or DNA with higher affinity and specificity than conventional oligonucleotides and oligonucleotide analogs. The properties of PNA enable novel molecular biology and biochemistry applications unachievable with traditional oligonucleotides and peptides.

Additional examples of nucleic acid modifications that improve the binding properties and/or stability of a nucleic acid include the use of base analogs such as inosine, intercalators (U.S. Pat. No. 4,835,263) and the minor groove binders (U.S. Pat. No. 5,801,115). Thus, references herein to nucleic acid molecules, SNP-containing nucleic acid molecules, SNP detection reagents (e.g., probes and primers), oligonucleotides/polynucleotides include PNA oligomers and other nucleic acid analogs. Other examples of nucleic acid analogs and alternative/modified nucleic acid chemistries known in the art are described in *Current Protocols in Nucleic Acid Chemistry*, John Wiley & Sons, N.Y. (2002).

The present invention further provides nucleic acid molecules that encode fragments of the variant polypeptides disclosed herein as well as nucleic acid molecules that encode obvious variants of such variant polypeptides. Such nucleic acid molecules may be naturally occurring, such as paralogs (different locus) and orthologs (different organism), or may be constructed by recombinant DNA methods or by chemical synthesis. Non-naturally occurring variants may be made by mutagenesis techniques, including those applied to nucleic acid molecules, cells, or organisms. Accordingly, the variants can contain nucleotide substitutions, deletions, inversions and insertions (in addition to the SNPs disclosed in Tables 1 and 2). Variation can occur in either or both the coding and non-coding regions. The variations can produce conservative and/or non-conservative amino acid substitutions.

Further variants of the nucleic acid molecules disclosed in Tables 1 and 2, such as naturally occurring allelic variants (as well as orthologs and paralogs) and synthetic variants produced by mutagenesis techniques, can be identified and/or produced using methods well known in the art. Such further variants can comprise a nucleotide sequence that shares at least 70-80%, 80-85%, 85-90%, 91%, 92%, 93%, 94%, 95%, 96%, 97%, 98%, or 99% sequence identity with a nucleic acid sequence disclosed in Table 1 and/or Table 2 (or a fragment thereof) and that includes a novel SNP allele disclosed in Table 1 and/or Table 2. Further, variants can comprise a nucleotide sequence that encodes a polypeptide that shares at least 70-80%, 80-85%, 85-90%, 91%, 92%, 93%, 94%, 95%, 96%, 97%, 98%, or 99% sequence identity with a polypeptide sequence disclosed in Table 1 (or a fragment thereof) and that includes a novel SNP allele disclosed in Table 1 and/or Table 2. Thus, an aspect of the present invention that is specifically contemplated are isolated nucleic acid molecules that have a certain degree of sequence variation compared with the sequences shown in Tables 1-2, but that contain a novel SNP allele disclosed herein. In other words, as long as an isolated nucleic acid molecule contains a novel SNP allele disclosed herein, other portions of the nucleic acid molecule that flank the novel SNP allele can vary to some degree from the specific transcript, genomic, and context sequences referred to and shown in Tables 1 and 2, and can encode a polypeptide that varies to some degree from the specific polypeptide sequences referred to in Table 1.

To determine the percent identity of two amino acid sequences or two nucleotide sequences of two molecules that share sequence homology, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. *Computational Molecular Biology*, A. M. Lesk, ed., Oxford University Press, N.Y (1988); *Biocomputing: Informatics and Genome Projects*, D. W. Smith, ed., Academic Press, N.Y. (1993); *Computer Analysis of Sequence Data, Part* 1, A. M. Griffin and H. G. Griffin, eds., Humana Press, N. J. (1994); *Sequence Analysis in Molecular Biology*, G. von Heinje, ed., Academic Press, N.Y. (1987); and *Sequence Analysis Primer*, M. Gribskov and J. Devereux, eds., M. Stockton Press, N.Y. (1991). In a preferred embodiment, the percent identity between two amino acid sequences is determined using the Needleman and Wunsch algorithm (*J Mol Biol* (48):444-453 (1970)) which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6.

In yet another preferred embodiment, the percent identity between two nucleotide sequences is determined using the GAP program in the GCG software package using a NWSgapdna.CMP matrix and a gap weight of 40, 50, 60, 70, or 80 and a length weight of 1, 2, 3, 4, 5, or 6. J. Devereux et al., *Nucleic Acids Res.* 12 (1):387 (1984). In another embodiment, the percent identity between two amino acid or nucleotide sequences is determined using the algorithm of E. Myers and W. Miller (CABIOS 4:11-17 (1989)) which has been incorporated into the ALIGN program (version 2.0), using a PAM120 weight residue table, a gap length penalty of 12, and a gap penalty of 4.

The nucleotide and amino acid sequences of the present invention can further be used as a "query sequence" to perform a search against sequence databases; for example, to identify other family members or related sequences. Such searches can be performed using the NBLAST and XBLAST programs (version 2.0). Altschul et al., *J Mol Biol* 215:403-10 (1990). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized. Altschul et al., *Nucleic Acids Res* 25 (17):3389-3402 (1997). When utilizing BLAST and gapped BLAST programs, the default parameters of the respective programs (e.g., XBLAST and NBLAST) can be used. In addition to BLAST, examples of other search and sequence comparison programs used in the art include, but are not limited to, FASTA (Pearson, *Methods Mol Biol* 25, 365-389 (1994)) and KERR (Dufresne et al., *Nat Biotechnol* 20 (12):1269-71 (December 2002)). For further information regarding bioinformatics techniques, see *Current Protocols in Bioinformatics*, John Wiley & Sons, Inc., N.Y.

The present invention further provides non-coding fragments of the nucleic acid molecules disclosed in Table 1 and/or Table 2. Preferred non-coding fragments include, but are not limited to, promoter sequences, enhancer sequences, intronic sequences, 5' untranslated regions (UTRs), 3' untranslated regions, gene modulating sequences and gene termination sequences. Such fragments are useful, for example, in controlling heterologous gene expression and in developing screens to identify gene-modulating agents.

SNP Detection Reagents

In a specific aspect of the present invention, the SNPs disclosed in Table 1 and/or Table 2, and their associated transcript sequences (referred to in Table 1 as SEQ ID NOS: 1-307), genomic sequences (referred to in Table 2 as SEQ ID NOS:1015-1400), and context sequences (transcript-based context sequences are referred to in Table 1 as SEQ ID NOS: 615-1014; genomic-based context sequences are provided in Table 2 as SEQ ID NOS:1401-4006 and 5414), can be used for the design of SNP detection reagents. The actual sequences referred to in the tables are provided in the Sequence Listing. As used herein, a "SNP detection reagent" is a reagent that specifically detects a specific target SNP position disclosed herein, and that is preferably specific for a particular nucleotide (allele) of the target SNP position (i.e., the detection reagent preferably can differentiate between different alternative nucleotides at a target SNP position, thereby allowing the identity of the nucleotide present at the target SNP position to be determined). Typically, such detection reagent hybridizes to a target SNP-containing nucleic acid molecule by complementary base-pairing in a sequence specific manner, and discriminates the target variant sequence from other nucleic acid sequences such as an art-known form in a test sample. An example of a detection reagent is a probe that hybridizes to a target nucleic acid containing one or more of the SNPs referred to in Table 1 and/or Table 2. In a preferred embodiment, such a probe can differentiate between nucleic acids having a particular nucleotide (allele) at a target SNP position from other nucleic acids that have a different nucleotide at the same target SNP position. In addition, a detection reagent may hybridize to a specific region 5' and/or 3' to a SNP position, particularly a region corresponding to the context sequences referred to in Table 1 and/or Table 2 (transcript-based context sequences are referred to in Table 1 as SEQ ID NOS:615-1014; genomic-based context sequences are referred to in Table 2 as SEQ ID NOS:1401-4006 and 5414). Another example of a detection reagent is a primer that acts as an initiation point of nucleotide extension along a complementary strand of a target polynucleotide. The SNP sequence information provided herein is also useful for designing primers, e.g. allele-specific primers, to amplify (e.g., using PCR) any SNP of the present invention.

In one preferred embodiment of the invention, a SNP detection reagent is an isolated or synthetic DNA or RNA polynucleotide probe or primer or PNA oligomer, or a combination of DNA, RNA and/or PNA, that hybridizes to a segment of a target nucleic acid molecule containing a SNP identified in Table 1 and/or Table 2. A detection reagent in the form of a polynucleotide may optionally contain modified base analogs, intercalators or minor groove binders. Multiple detection reagents such as probes may be, for example, affixed to a solid support (e.g., arrays or beads) or supplied in solution (e.g. probe/primer sets for enzymatic reactions such as PCR, RT-PCR, TaqMan assays, or primer-extension reactions) to form a SNP detection kit.

A probe or primer typically is a substantially purified oligonucleotide or PNA oligomer. Such oligonucleotide typically comprises a region of complementary nucleotide sequence that hybridizes under stringent conditions to at least about 8, 10, 12, 16, 18, 20, 22, 25, 30, 40, 50, 55, 60, 65, 70, 80, 90, 100, 120 (or any other number in-between) or more consecutive nucleotides in a target nucleic acid molecule. Depending on the particular assay, the consecutive nucleotides can either include the target SNP position, or be a specific region in close enough proximity 5' and/or 3' to the SNP position to carry out the desired assay.

Other preferred primer and probe sequences can readily be determined using the transcript sequences (SEQ ID NOS:1-307), genomic sequences (SEQ ID NOS:1015-1400), and SNP context sequences (transcript-based context sequences are referred to in Table 1 as SEQ ID NOS:615-1014; genomic-based context sequences are referred to in Table 2 as SEQ ID NOS:1401-4006 and 5414) disclosed in the Sequence Listing and in Tables 1 and 2. The actual sequences referred to in the tables are provided in the Sequence Listing. It will be apparent to one of skill in the art that such primers and probes are directly useful as reagents for genotyping the SNPs of the present invention, and can be incorporated into any kit/system format.

In order to produce a probe or primer specific for a target SNP-containing sequence, the gene/transcript and/or context sequence surrounding the SNP of interest is typically examined using a computer algorithm that starts at the 5' or at the 3' end of the nucleotide sequence. Typical algorithms will then identify oligomers of defined length that are unique to the gene/SNP context sequence, have a GC content within a range suitable for hybridization, lack predicted secondary structure that may interfere with hybridization, and/or possess other desired characteristics or that lack other undesired characteristics.

A primer or probe of the present invention is typically at least about 8 nucleotides in length. In one embodiment of the invention, a primer or a probe is at least about 10 nucleotides in length. In a preferred embodiment, a primer or a probe is at least about 12 nucleotides in length. In a more preferred embodiment, a primer or probe is at least about 16, 17, 18, 19, 20, 21, 22, 23, 24 or 25 nucleotides in length. While the maximal length of a probe can be as long as the target sequence to be detected, depending on the type of assay in which it is employed, it is typically less than about 50, 60, 65, or 70 nucleotides in length. In the case of a primer, it is typically less than about 30 nucleotides in length. In a specific preferred embodiment of the invention, a primer or a probe is within the length of about 18 and about 28 nucleotides. However, in other embodiments, such as nucleic acid arrays and other embodiments in which probes are affixed to a substrate, the probes can be longer, such as on the order of 30-70, 75, 80, 90, 100, or more nucleotides in length (see the section below entitled "SNP Detection Kits and Systems").

For analyzing SNPs, it may be appropriate to use oligonucleotides specific for alternative SNP alleles. Such oligonucleotides that detect single nucleotide variations in target sequences may be referred to by such terms as "allele-specific oligonucleotides," "allele-specific probes," or "allele-specific primers." The design and use of allele-specific probes for analyzing polymorphisms is described in, e.g., *Mutation Detection: A Practical Approach*, Cotton et al., eds., Oxford University Press (1998); Saiki et al., *Nature* 324:163-166 (1986); Dattagupta, EP235,726; and Saiki, WO 89/11548.

While the design of each allele-specific primer or probe depends on variables such as the precise composition of the nucleotide sequences flanking a SNP position in a target nucleic acid molecule, and the length of the primer or probe, another factor in the use of primers and probes is the stringency of the condition under which the hybridization between the probe or primer and the target sequence is performed. Higher stringency conditions utilize buffers with lower ionic strength and/or a higher reaction temperature, and tend to require a more perfect match between probe/primer and a target sequence in order to form a stable duplex. If the stringency is too high, however, hybridization may not occur at all. In contrast, lower stringency conditions utilize buffers with higher ionic strength and/or a lower reaction temperature, and permit the formation of stable duplexes with more mismatched bases between a probe/primer and a target sequence. By way of example and not limitation, exemplary conditions for high stringency hybridization conditions using an allele-specific probe are as follows: prehybridization with a solution containing 5× standard saline phosphate EDTA (SSPE), 0.5% NaDodSO$_4$ (SDS) at 55° C., and incubating probe with target nucleic acid molecules in the same solution at the same temperature, followed by washing with a solution containing 2×SSPE, and 0.1% SDS at 55° C. or room temperature.

Moderate stringency hybridization conditions may be used for allele-specific primer extension reactions with a solution containing, e.g., about 50 mM KCl at about 46° C. Alternatively, the reaction may be carried out at an elevated temperature such as 60° C. In another embodiment, a moderately stringent hybridization condition suitable for oligonucleotide ligation assay (OLA) reactions wherein two probes are ligated if they are completely complementary to the target sequence may utilize a solution of about 100 mM KCl at a temperature of 46° C.

In a hybridization-based assay, allele-specific probes can be designed that hybridize to a segment of target DNA from one individual but do not hybridize to the corresponding segment from another individual due to the presence of different polymorphic forms (e.g., alternative SNP alleles/nucleotides) in the respective DNA segments from the two individuals. Hybridization conditions should be sufficiently stringent that there is a significant detectable difference in hybridization intensity between alleles, and preferably an essentially binary response, whereby a probe hybridizes to only one of the alleles or significantly more strongly to one allele. While a probe may be designed to hybridize to a target sequence that contains a SNP site such that the SNP site aligns anywhere along the sequence of the probe, the probe is preferably designed to hybridize to a segment of the target sequence such that the SNP site aligns with a central position of the probe (e.g., a position within the probe that is at least three nucleotides from either end of the probe). This design of probe generally achieves good discrimination in hybridization between different allelic forms.

In another embodiment, a probe or primer may be designed to hybridize to a segment of target DNA such that the SNP aligns with either the 5' most end or the 3' most end of the probe or primer. In a specific preferred embodiment that is particularly suitable for use in a oligonucleotide ligation assay (U.S. Pat. No. 4,988,617), the 3' most nucleotide of the probe aligns with the SNP position in the target sequence.

Oligonucleotide probes and primers may be prepared by methods well known in the art. Chemical synthetic methods include, but are not limited to, the phosphotriester method described by Narang et al., *Methods in Enzymology* 68:90 (1979); the phosphodiester method described by Brown et al., *Methods in Enzymology* 68:109 (1979); the diethylphosphoamidate method described by Beaucage et al., *Tetrahedron Letters* 22:1859 (1981); and the solid support method described in U.S. Pat. No. 4,458,066.

Allele-specific probes are often used in pairs (or, less commonly, in sets of 3 or 4, such as if a SNP position is known to have 3 or 4 alleles, respectively, or to assay both strands of a nucleic acid molecule for a target SNP allele), and such pairs may be identical except for a one nucleotide mismatch that represents the allelic variants at the SNP position. Commonly, one member of a pair perfectly matches a reference form of a target sequence that has a more common SNP allele (i.e., the allele that is more frequent in the target population) and the other member of the pair perfectly matches a form of the target sequence that has a less common SNP allele (i.e., the allele that is rarer in the target population). In the case of an array, multiple pairs of probes can be immobilized on the same support for simultaneous analysis of multiple different polymorphisms.

In one type of PCR-based assay, an allele-specific primer hybridizes to a region on a target nucleic acid molecule that overlaps a SNP position and only primes amplification of an allelic form to which the primer exhibits perfect complementarity. Gibbs, *Nucleic Acid Res* 17:2427-2448 (1989). Typically, the primer's 3'-most nucleotide is aligned with and complementary to the SNP position of the target nucleic acid molecule. This primer is used in conjunction with a second primer that hybridizes at a distal site. Amplification proceeds from the two primers, producing a detectable product that indicates which allelic form is present in the test sample. A control is usually performed with a second pair of primers, one of which shows a single base mismatch at the polymorphic site and the other of which exhibits perfect complementarity to a distal site. The single-base mismatch prevents amplification or substantially reduces amplification efficiency, so that either no detectable product is formed or it is formed in lower amounts or at a slower pace. The method generally works most effectively when the mismatch is at the 3'-most position of the oligonucleotide (i.e., the 3'-most position of the oligonucleotide aligns with the target SNP position) because this position is most destabilizing to elongation from the primer (see, e.g., WO 93/22456). This PCR-based assay can be utilized as part of the TaqMan assay, described below.

In a specific embodiment of the invention, a primer of the invention contains a sequence substantially complementary to a segment of a target SNP-containing nucleic acid molecule except that the primer has a mismatched nucleotide in one of the three nucleotide positions at the 3'-most end of the primer, such that the mismatched nucleotide does not base pair with a particular allele at the SNP site. In a preferred embodiment, the mismatched nucleotide in the primer is the second from the last nucleotide at the 3'-most position of the primer. In a more preferred embodiment, the mismatched nucleotide in the primer is the last nucleotide at the 3'-most position of the primer.

In another embodiment of the invention, a SNP detection reagent of the invention is labeled with a fluorogenic reporter dye that emits a detectable signal. While the preferred reporter dye is a fluorescent dye, any reporter dye that can be attached to a detection reagent such as an oligonucleotide probe or primer is suitable for use in the invention. Such dyes include, but are not limited to, Acridine, AMCA, BODIPY, Cascade Blue, Cy2, Cy3, Cy5, Cy7, Dabcyl, Edans, Eosin, Erythrosin, Fluorescein, 6-Fam, Tet, Joe, Hex, Oregon Green, Rhodamine, Rhodol Green, Tamra, Rox, and Texas Red.

In yet another embodiment of the invention, the detection reagent may be further labeled with a quencher dye such as Tamra, especially when the reagent is used as a self-quenching probe such as a TaqMan (U.S. Pat. Nos. 5,210,015 and 5,538,848) or Molecular Beacon probe (U.S. Pat. Nos. 5,118, 801 and 5,312,728), or other stemless or linear beacon probe (Livak et al., *PCR Method Appl* 4:357-362 (1995); Tyagi et al., *Nature Biotechnology* 14:303-308 (1996); Nazarenko et al., *Nucl Acids Res* 25:2516-2521 (1997); U.S. Pat. Nos. 5,866,336 and 6,117,635.

The detection reagents of the invention may also contain other labels, including but not limited to, biotin for streptavidin binding, hapten for antibody binding, and oligonucleotide for binding to another complementary oligonucleotide such as pairs of zipcodes.

The present invention also contemplates reagents that do not contain (or that are complementary to) a SNP nucleotide identified herein but that are used to assay one or more SNPs disclosed herein. For example, primers that flank, but do not hybridize directly to a target SNP position provided herein are useful in primer extension reactions in which the primers hybridize to a region adjacent to the target SNP position (i.e., within one or more nucleotides from the target SNP site). During the primer extension reaction, a primer is typically not able to extend past a target SNP site if a particular nucleotide (allele) is present at that target SNP site, and the primer extension product can be detected in order to determine which SNP allele is present at the target SNP site. For example, particular ddNTPs are typically used in the primer extension reaction to terminate primer extension once a ddNTP is incorporated into the extension product (a primer extension product which includes a ddNTP at the 3'-most end of the primer extension product, and in which the ddNTP is a nucleotide of a SNP disclosed herein, is a composition that is specifically contemplated by the present invention). Thus, reagents that bind to a nucleic acid molecule in a region adjacent to a SNP site and that are used for assaying the SNP site, even though the bound sequences do not necessarily include the SNP site itself, are also contemplated by the present invention.

SNP Detection Kits and Systems

A person skilled in the art will recognize that, based on the SNP and associated sequence information disclosed herein, detection reagents can be developed and used to assay any SNP of the present invention individually or in combination, and such detection reagents can be readily incorporated into one of the established kit or system formats which are well known in the art. The terms "kits" and "systems," as used herein in the context of SNP detection reagents, are intended to refer to such things as combinations of multiple SNP detection reagents, or one or more SNP detection reagents in combination with one or more other types of elements or components (e.g., other types of biochemical reagents, containers, packages such as packaging intended for commercial sale, substrates to which SNP detection reagents are attached, electronic hardware components, etc.). Accordingly, the present invention further provides SNP detection kits and systems, including but not limited to, packaged probe and primer sets (e.g. TaqMan probe/primer sets), arrays/microarrays of nucleic acid molecules, and beads that contain one or more probes, primers, or other detection reagents for detecting one or more SNPs of the present invention. The kits/systems can optionally include various electronic hardware components; for example, arrays ("DNA chips") and microfluidic systems ("lab-on-a-chip" systems) provided by various manufacturers typically comprise hardware components. Other kits/systems (e.g., probe/primer sets) may not include electronic hardware components, but may be comprised of, for example, one or more SNP detection reagents (along with, optionally, other biochemical reagents) packaged in one or more containers.

In some embodiments, a SNP detection kit typically contains one or more detection reagents and other components (e.g. a buffer, enzymes such as DNA polymerases or ligases, chain extension nucleotides such as deoxynucleotide triphosphates, and in the case of Sanger-type DNA sequencing reactions, chain terminating nucleotides, positive control sequences, negative control sequences, and the like) necessary to carry out an assay or reaction, such as amplification and/or detection of a SNP-containing nucleic acid molecule. A kit may further contain means for determining the amount of a target nucleic acid, and means for comparing the amount with a standard, and can comprise instructions for using the kit to detect the SNP-containing nucleic acid molecule of interest. In one embodiment of the present invention, kits are provided which contain the necessary reagents to carry out one or more assays to detect one or more SNPs disclosed herein. In a preferred embodiment of the present invention, SNP detection kits/systems are in the form of nucleic acid arrays, or compartmentalized kits, including microfluidic/lab-on-a-chip systems.

SNP detection kits/systems may contain, for example, one or more probes, or pairs of probes, that hybridize to a nucleic acid molecule at or near each target SNP position. Multiple pairs of allele-specific probes may be included in the kit/system to simultaneously assay large numbers of SNPs, at least one of which is a SNP of the present invention. In some kits/systems, the allele-specific probes are immobilized to a substrate such as an array or bead. For example, the same substrate can comprise allele-specific probes for detecting at least 1; 10; 100; 1000; 10,000; 100,000 (or any other number in-between) or substantially all of the SNPs shown in Table 1 and/or Table 2.

The terms "arrays," "microarrays," and "DNA chips" are used herein interchangeably to refer to an array of distinct polynucleotides affixed to a substrate, such as glass, plastic, paper, nylon or other type of membrane, filter, chip, or any other suitable solid support. The polynucleotides can be synthesized directly on the substrate, or synthesized separate from the substrate and then affixed to the substrate. In one embodiment, the microarray is prepared and used according to the methods described in Chee et al., U.S. Pat. No. 5,837,832 and PCT application WO95/11995; D. J. Lockhart et al., *Nat Biotech* 14:1675-1680 (1996); and M. Schena et al., *Proc Natl Acad Sci* 93:10614-10619 (1996), all of which are incorporated herein in their entirety by reference. In other embodiments, such arrays are produced by the methods described by Brown et al., U.S. Pat. No. 5,807,522.

Nucleic acid arrays are reviewed in the following references: Zammatteo et al., "New chips for molecular biology and diagnostics," *Biotechnol Annu Rev* 8:85-101 (2002); Sosnowski et al., "Active microelectronic array system for DNA hybridization, genotyping and pharmacogenomic applications," *Psychiatr Genet* 12 (4):181-92 (December 2002); Heller, "DNA microarray technology: devices, systems, and applications," *Annu Rev Biomed Eng* 4:129-53 (2002); Epub Mar. 22, 2002; Kolchinsky et al., "Analysis of SNPs and other genomic variations using gel-based chips," *Hum Mutat* 19 (4):343-60 (April 2002); and McGall et al., "High-density genechip oligonucleotide probe arrays," *Adv Biochem Eng Biotechnol* 77:21-42 (2002).

Any number of probes, such as allele-specific probes, may be implemented in an array, and each probe or pair of probes can hybridize to a different SNP position. In the case of polynucleotide probes, they can be synthesized at designated areas (or synthesized separately and then affixed to designated areas) on a substrate using a light-directed chemical process. Each DNA chip can contain, for example, thousands to millions of individual synthetic polynucleotide probes arranged in a grid-like pattern and miniaturized (e.g., to the size of a dime). Preferably, probes are attached to a solid support in an ordered, addressable array.

A microarray can be composed of a large number of unique, single-stranded polynucleotides, usually either synthetic antisense polynucleotides or fragments of cDNAs, fixed to a solid support. Typical polynucleotides are preferably about 6-60 nucleotides in length, more preferably about 15-30 nucleotides in length, and most preferably about 18-25 nucleotides in length. For certain types of microarrays or other detection kits/systems, it may be preferable to use oligonucleotides that are only about 7-20 nucleotides in length. In other types of arrays, such as arrays used in conjunction with chemiluminescent detection technology, preferred probe lengths can be, for example, about 15-80 nucleotides in length, preferably about 50-70 nucleotides in length, more preferably about 55-65 nucleotides in length, and most preferably about 60 nucleotides in length. The microarray or detection kit can contain polynucleotides that cover the known 5' or 3' sequence of a gene/transcript or target SNP site, sequential polynucleotides that cover the full-length sequence of a gene/transcript; or unique polynucleotides selected from particular areas along the length of a target gene/transcript sequence, particularly areas corresponding to one or more SNPs disclosed in Table 1 and/or Table 2. Polynucleotides used in the microarray or detection kit can be specific to a SNP or SNPs of interest (e.g., specific to a particular SNP allele at a target SNP site, or specific to particular SNP alleles at multiple different SNP sites), or specific to a polymorphic gene/transcript or genes/transcripts of interest.

Hybridization assays based on polynucleotide arrays rely on the differences in hybridization stability of the probes to perfectly matched and mismatched target sequence variants. For SNP genotyping, it is generally preferable that stringency conditions used in hybridization assays are high enough such that nucleic acid molecules that differ from one another at as little as a single SNP position can be differentiated (e.g., typical SNP hybridization assays are designed so that hybridization will occur only if one particular nucleotide is present at a SNP position, but will not occur if an alternative nucleotide is present at that SNP position). Such high stringency conditions may be preferable when using, for example, nucleic acid arrays of allele-specific probes for SNP detection. Such high stringency conditions are described in the preceding section, and are well known to those skilled in the art and can be found in, for example, *Current Protocols in Molecular Biology* 6.3.1-6.3.6, John Wiley & Sons, N.Y. (1989).

In other embodiments, the arrays are used in conjunction with chemiluminescent detection technology. The following patents and patent applications, which are all hereby incorporated by reference, provide additional information pertaining to chemiluminescent detection. U.S. patent applications that describe chemiluminescent approaches for microarray detection: 10/620,332 and 10/620,333. U.S. patents that describe methods and compositions of dioxetane for performing chemiluminescent detection: U.S. Pat. Nos. 6,124,478; 6,107,024; 5,994,073; 5,981,768; 5,871,938; 5,843,681; 5,800,999 and 5,773,628. And the U.S. published application that discloses methods and compositions for microarray controls: US2002/0110828.

In one embodiment of the invention, a nucleic acid array can comprise an array of probes of about 15-25 nucleotides in length. In further embodiments, a nucleic acid array can comprise any number of probes, in which at least one probe is capable of detecting one or more SNPs disclosed in Table 1 and/or Table 2, and/or at least one probe comprises a fragment of one of the sequences selected from the group consisting of those disclosed in Table 1, Table 2, the Sequence Listing, and sequences complementary thereto, said fragment comprising at least about 8 consecutive nucleotides, preferably 10, 12, 15, 16, 18, 20, more preferably 22, 25, 30, 40, 47, 50, 55, 60, 65, 70, 80, 90, 100, or more consecutive nucleotides (or any other number in-between) and containing (or being complementary to) a novel SNP allele disclosed in Table 1 and/or Table 2. In some embodiments, the nucleotide complementary to the SNP site is within 5, 4, 3, 2, or 1 nucleotide from the center of the probe, more preferably at the center of said probe.

A polynucleotide probe can be synthesized on the surface of the substrate by using a chemical coupling procedure and an ink jet application apparatus, as described in PCT application WO95/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more polynucleotides, or any other number which lends itself to the efficient use of commercially available instrumentation.

Using such arrays or other kits/systems, the present invention provides methods of identifying the SNPs disclosed herein in a test sample. Such methods typically involve incubating a test sample of nucleic acids with an array comprising one or more probes corresponding to at least one SNP position of the present invention, and assaying for binding of a nucleic acid from the test sample with one or more of the probes. Conditions for incubating a SNP detection reagent (or a kit/system that employs one or more such SNP detection reagents) with a test sample vary. Incubation conditions depend on such factors as the format employed in the assay, the detection methods employed, and the type and nature of the detection reagents used in the assay. One skilled in the art will recognize that any one of the commonly available hybridization, amplification and array assay formats can readily be adapted to detect the SNPs disclosed herein.

A SNP detection kit/system of the present invention may include components that are used to prepare nucleic acids from a test sample for the subsequent amplification and/or detection of a SNP-containing nucleic acid molecule. Such sample preparation components can be used to produce nucleic acid extracts (including DNA and/or RNA), proteins or membrane extracts from any bodily fluids (such as blood, serum, plasma, urine, saliva, phlegm, gastric juices, semen, tears, sweat, etc.), skin, hair, cells (especially nucleated cells), biopsies, buccal swabs or tissue specimens. The test samples used in the above-described methods will vary based on such factors as the assay format, nature of the detection method, and the specific tissues, cells or extracts used as the test sample to be assayed. Methods of preparing nucleic acids, proteins, and cell extracts are well known in the art and can be readily adapted to obtain a sample that is compatible with the system utilized. Automated sample preparation systems for extracting nucleic acids from a test sample are commercially available, and examples are Qiagen's BioRobot 9600, Applied Biosystems' PRISM™ 6700 sample preparation system, and Roche Molecular Systems' COBAS AmpliPrep System.

Another form of kit contemplated by the present invention is a compartmentalized kit. A compartmentalized kit includes any kit in which reagents are contained in separate containers. Such containers include, for example, small glass containers, plastic containers, strips of plastic, glass or paper, or arraying material such as silica. Such containers allow one to efficiently transfer reagents from one compartment to another compartment such that the test samples and reagents are not cross-contaminated, or from one container to another vessel not included in the kit, and the agents or solutions of each container can be added in a quantitative fashion from one compartment to another or to another vessel. Such containers may include, for example, one or more containers which will accept the test sample, one or more containers which contain at least one probe or other SNP detection reagent for detecting one or more SNPs of the present invention, one or more containers which contain wash reagents (such as phosphate buffered saline, Tris-buffers, etc.), and one or more containers which contain the reagents used to reveal the presence of the bound probe or other SNP detection reagents. The kit can optionally further comprise compartments and/or reagents for, for example, nucleic acid amplification or other enzymatic reactions such as primer extension reactions, hybridization, ligation, electrophoresis (preferably capillary electrophoresis), mass spectrometry, and/or laser-induced fluorescent detection. The kit may also include instructions for using the kit. Exemplary compartmentalized kits include microfluidic devices known in the art. See, e.g., Weigl et al, "Lab-on-a-chip for drug development," *Adv Drug Deliv Rev*

55 (3):349-77 (February 2003). In such microfluidic devices, the containers may be referred to as, for example, microfluidic "compartments," "chambers," or "channels."

Microfluidic devices, which may also be referred to as "lab-on-a-chip" systems, biomedical micro-electro-mechanical systems (bioMEMs), or multicomponent integrated systems, are exemplary kits/systems of the present invention for analyzing SNPs. Such systems miniaturize and compartmentalize processes such as probe/target hybridization, nucleic acid amplification, and capillary electrophoresis reactions in a single functional device. Such microfluidic devices typically utilize detection reagents in at least one aspect of the system, and such detection reagents may be used to detect one or more SNPs of the present invention. One example of a microfluidic system is disclosed in U.S. Pat. No. 5,589,136, which describes the integration of PCR amplification and capillary electrophoresis in chips. Exemplary microfluidic systems comprise a pattern of microchannels designed onto a glass, silicon, quartz, or plastic wafer included on a microchip. The movements of the samples may be controlled by electric, electroosmotic or hydrostatic forces applied across different areas of the microchip to create functional microscopic valves and pumps with no moving parts. Varying the voltage can be used as a means to control the liquid flow at intersections between the micro-machined channels and to change the liquid flow rate for pumping across different sections of the microchip. See, for example, U.S. Pat. Nos. 6,153,073, Dubrow et al., and 6,156,181, Parce et al.

For genotyping SNPs, an exemplary microfluidic system may integrate, for example, nucleic acid amplification, primer extension, capillary electrophoresis, and a detection method such as laser induced fluorescence detection. In a first step of an exemplary process for using such an exemplary system, nucleic acid samples are amplified, preferably by PCR. Then, the amplification products are subjected to automated primer extension reactions using ddNTPs (specific fluorescence for each ddNTP) and the appropriate oligonucleotide primers to carry out primer extension reactions which hybridize just upstream of the targeted SNP. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. Such an exemplary microchip can be used to process, for example, at least 96 to 384 samples, or more, in parallel.

Uses of Nucleic Acid Molecules

The nucleic acid molecules of the present invention have a variety of uses, especially for the diagnosis, prognosis, treatment, and prevention of CVD (particularly CHD, such as MI, or hypertension). For example, the nucleic acid molecules of the invention are useful for predicting an individual's risk for developing CVD (particularly the risk for CHD, especially MI, or hypertension), for prognosing the progression of CVD (e.g., the severity or consequences of CHD, particularly MI, or hypertension) in an individual, in evaluating the likelihood of an individual who has CVD (or who is at increased risk for CVD) of responding to treatment (or prevention) of CVD with a particular therapeutic agent, and/or predicting the likelihood that the individual will experience toxicity or other undesirable side effects from a treatment, etc. For example, the nucleic acid molecules are useful as hybridization probes, such as for genotyping SNPs in messenger RNA, transcript, cDNA, genomic DNA, amplified DNA or other nucleic acid molecules, and for isolating full-length cDNA and genomic clones encoding the variant peptides disclosed in Table 1 as well as their orthologs.

A probe can hybridize to any nucleotide sequence along the entire length of a nucleic acid molecule referred to in Table 1 and/or Table 2. Preferably, a probe of the present invention hybridizes to a region of a target sequence that encompasses a SNP position indicated in Table 1 and/or Table 2. More preferably, a probe hybridizes to a SNP-containing target sequence in a sequence-specific manner such that it distinguishes the target sequence from other nucleotide sequences which vary from the target sequence only by which nucleotide is present at the SNP site. Such a probe is particularly useful for detecting the presence of a SNP-containing nucleic acid in a test sample, or for determining which nucleotide (allele) is present at a particular SNP site (i.e., genotyping the SNP site).

A nucleic acid hybridization probe may be used for determining the presence, level, form, and/or distribution of nucleic acid expression. The nucleic acid whose level is determined can be DNA or RNA. Accordingly, probes specific for the SNPs described herein can be used to assess the presence, expression and/or gene copy number in a given cell, tissue, or organism. These uses are relevant for diagnosis of disorders involving an increase or decrease in gene expression relative to normal levels. In vitro techniques for detection of mRNA include, for example, Northern blot hybridizations and in situ hybridizations. In vitro techniques for detecting DNA include Southern blot hybridizations and in situ hybridizations. Sambrook and Russell, *Molecular Cloning: A Laboratory Manual*, Cold Spring Harbor Press, N.Y. (2000).

Probes can be used as part of a diagnostic test kit for identifying cells or tissues in which a variant protein is expressed, such as by measuring the level of a variant protein-encoding nucleic acid (e.g., mRNA) in a sample of cells from a subject or determining if a polynucleotide contains a SNP of interest.

Thus, the nucleic acid molecules of the invention can be used as hybridization probes to detect the SNPs disclosed herein, thereby determining whether an individual with the polymorphism(s) is at risk for developing CVD (or has already developed early stage CVD), or the likelihood that an individual will respond positively to a treatment (including preventive treatment) for CVD such as a particular therapeutic agent. Detection of a SNP associated with a disease phenotype provides a diagnostic tool for an active disease and/or genetic predisposition to the disease.

Furthermore, the nucleic acid molecules of the invention are therefore useful for detecting a gene (gene information is disclosed in Table 2, for example) which contains a SNP disclosed herein and/or products of such genes, such as expressed mRNA transcript molecules (transcript information is disclosed in Table 1, for example), and are thus useful for detecting gene expression. The nucleic acid molecules can optionally be implemented in, for example, an array or kit format for use in detecting gene expression.

The nucleic acid molecules of the invention are also useful as primers to amplify any given region of a nucleic acid molecule, particularly a region containing a SNP identified in Table 1 and/or Table 2.

The nucleic acid molecules of the invention are also useful for constructing recombinant vectors (described in greater detail below). Such vectors include expression vectors that express a portion of, or all of, any of the variant peptide sequences referred to in Table 1. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced SNPs.

The nucleic acid molecules of the invention are also useful for expressing antigenic portions of the variant proteins, particularly antigenic portions that contain a variant amino acid sequence (e.g., an amino acid substitution) caused by a SNP disclosed in Table 1 and/or Table 2.

The nucleic acid molecules of the invention are also useful for constructing vectors containing a gene regulatory region of the nucleic acid molecules of the present invention.

The nucleic acid molecules of the invention are also useful for designing ribozymes corresponding to all, or a part, of an mRNA molecule expressed from a SNP-containing nucleic acid molecule described herein.

The nucleic acid molecules of the invention are also useful for constructing host cells expressing a part, or all, of the nucleic acid molecules and variant peptides.

The nucleic acid molecules of the invention are also useful for constructing transgenic animals expressing all, or a part, of the nucleic acid molecules and variant peptides. The production of recombinant cells and transgenic animals having nucleic acid molecules which contain the SNPs disclosed in Table 1 and/or Table 2 allows, for example, effective clinical design of treatment compounds and dosage regimens.

The nucleic acid molecules of the invention are also useful in assays for drug screening to identify compounds that, for example, modulate nucleic acid expression.

The nucleic acid molecules of the invention are also useful in gene therapy in patients whose cells have aberrant gene expression. Thus, recombinant cells, which include a patient's cells that have been engineered ex vivo and returned to the patient, can be introduced into an individual where the recombinant cells produce the desired protein to treat the individual.

SNP Genotyping Methods

The process of determining which nucleotide(s) is/are present at each of one or more SNP positions (such as a SNP position disclosed in Table 1 and/or Table 2), for either or both alleles, may be referred to by such phrases as SNP genotyping, determining the "identity" of a SNP, determining the "content" of a SNP, or determining which nucleotide(s)/allele(s) is/are present at a SNP position. Thus, these terms can refer to detecting a single allele (nucleotide) at a SNP position or can encompass detecting both alleles (nucleotides) at a SNP position (such as to determine the homozygous or heterozygous state of a SNP position). Furthermore, these terms may also refer to detecting an amino acid residue encoded by a SNP (such as alternative amino acid residues that are encoded by different codons created by alternative nucleotides at a SNP position).

The present invention provides methods of SNP genotyping, such as for use in evaluating an individual's risk for developing CVD (particularly CHD, such as MI, or hypertension), for evaluating an individual's prognosis for disease severity and recovery, for predicting the likelihood that an individual who has previously had CVD (such as CHD, particularly MI, or hypertension) will have a recurrence of CVD again in the future, for implementing a preventive or treatment regimen for an individual based on that individual having an increased susceptibility for developing CVD (e.g., increased risk for CHD, particularly MI, or hypertension), in evaluating an individual's likelihood of responding to a therapeutic treatment (particularly for treating or preventing CVD), in selecting a treatment or preventive regimen (e.g., in deciding whether or not to administer a particular therapeutic agent to an individual having CVD, or who is at increased risk for developing CVD in the future), or in formulating or selecting a particular treatment or preventive regimen such as dosage and/or frequency of administration of a therapeutic agent or choosing which form/type of a therapeutic agent to be administered, such as a particular pharmaceutical composition or compound, etc.), determining the likelihood of experiencing toxicity or other undesirable side effects from a treatment, or selecting individuals for a clinical trial of a therapeutic agent (e.g., selecting individuals to participate in the trial who are most likely to respond positively to a therapeutic agent and/or excluding individuals from the trial who are unlikely to respond positively to a therapeutic agent based on their SNP genotype(s), or selecting individuals who are unlikely to respond positively to a particular therapeutic agent based on their SNP genotype(s) to participate in a clinical trial of another therapeutic agent that may benefit them), etc.

Nucleic acid samples can be genotyped to determine which allele(s) is/are present at any given genetic region (e.g., SNP position) of interest by methods well known in the art. The neighboring sequence can be used to design SNP detection reagents such as oligonucleotide probes, which may optionally be implemented in a kit format. Exemplary SNP genotyping methods are described in Chen et al., "Single nucleotide polymorphism genotyping: biochemistry, protocol, cost and throughput," *Pharmacogenomics J* 3 (2):77-96 (2003); Kwok et al., "Detection of single nucleotide polymorphisms," *Curr Issues Mol Biol* 5 (2):43-60 (April 2003); Shi, "Technologies for individual genotyping: detection of genetic polymorphisms in drug targets and disease genes," *Am J Pharmacogenomics* 2 (3):197-205 (2002); and Kwok, "Methods for genotyping single nucleotide polymorphisms," *Annu Rev Genomics Hum Genet* 2:235-58 (2001). Exemplary techniques for high-throughput SNP genotyping are described in Mamellos, "High-throughput SNP analysis for genetic association studies," *Curr Opin Drug Discov Devel* 6 (3):317-21 (May 2003). Common SNP genotyping methods include, but are not limited to, TaqMan assays, molecular beacon assays, nucleic acid arrays, allele-specific primer extension, allele-specific PCR, arrayed primer extension, homogeneous primer extension assays, primer extension with detection by mass spectrometry, pyrosequencing, multiplex primer extension sorted on genetic arrays, ligation with rolling circle amplification, homogeneous ligation, OLA (U.S. Pat. No. 4,988,167), multiplex ligation reaction sorted on genetic arrays, restriction-fragment length polymorphism, single base extension-tag assays, and the Invader assay. Such methods may be used in combination with detection mechanisms such as, for example, luminescence or chemiluminescence detection, fluorescence detection, time-resolved fluorescence detection, fluorescence resonance energy transfer, fluorescence polarization, mass spectrometry, and electrical detection.

Various methods for detecting polymorphisms include, but are not limited to, methods in which protection from cleavage agents is used to detect mismatched bases in RNA/RNA or RNA/DNA duplexes (Myers et al., *Science* 230:1242 (1985); Cotton et al., *PNAS* 85:4397 (1988); and Saleeba et al., *Meth. Enzymol* 217:286-295 (1992)), comparison of the electrophoretic mobility of variant and wild type nucleic acid molecules (Orita et al, *PNAS* 86:2766 (1989); Cotton et al, *Mutat Res* 285:125-144 (1993); and Hayashi et al., *Genet Anal Tech Appl* 9:73-79 (1992)), and assaying the movement of polymorphic or wild-type fragments in polyacrylamide gels containing a gradient of denaturant using denaturing gradient gel electrophoresis (DGGE) (Myers et al., *Nature* 313:495 (1985)). Sequence variations at specific locations can also be assessed by nuclease protection assays such as RNase and S1 protection or chemical cleavage methods.

In a preferred embodiment, SNP genotyping is performed using the TaqMan assay, which is also known as the 5' nuclease assay (U.S. Pat. Nos. 5,210,015 and 5,538,848). The TaqMan assay detects the accumulation of a specific amplified product during PCR. The TaqMan assay utilizes an oligonucleotide probe labeled with a fluorescent reporter dye and a quencher dye. The reporter dye is excited by irradiation at an appropriate wavelength, it transfers energy to the quencher dye in the same probe via a process called fluorescence resonance energy transfer (FRET). When attached to the probe, the excited reporter dye does not emit a signal. The proximity of the quencher dye to the reporter dye in the intact probe maintains a reduced fluorescence for the reporter. The reporter dye and quencher dye may be at the 5' most and the 3' most ends, respectively, or vice versa. Alternatively, the reporter dye may be at the 5' or 3' most end while the quencher dye is attached to an internal nucleotide, or vice versa. In yet another embodiment, both the reporter and the quencher may be attached to internal nucleotides at a distance from each other such that fluorescence of the reporter is reduced.

During PCR, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The DNA polymerase cleaves the probe between the reporter dye and the quencher dye only if the probe hybridizes to the target SNP-containing template which is amplified during PCR, and the probe is designed to hybridize to the target SNP site only if a particular SNP allele is present.

Preferred TaqMan primer and probe sequences can readily be determined using the SNP and associated nucleic acid sequence information provided herein. A number of computer programs, such as Primer Express (Applied Biosystems, Foster City, Calif.), can be used to rapidly obtain optimal primer/probe sets. It will be apparent to one of skill in the art that such primers and probes for detecting the SNPs of the present invention are useful in, for example, screening for individuals who are susceptible to developing CVD (particularly CHD, such as MI, or hypertension) and related pathologies, or in screening individuals who have CVD (or who are susceptible to CVD) for their likelihood of responding to a particular treatment (e.g., a particular therapeutic agent). These probes and primers can be readily incorporated into a kit format. The present invention also includes modifications of the Taqman assay well known in the art such as the use of Molecular Beacon probes (U.S. Pat. Nos. 5,118,801 and 5,312,728) and other variant formats (U.S. Pat. Nos. 5,866,336 and 6,117,635).

Another preferred method for genotyping the SNPs of the present invention is the use of two oligonucleotide probes in an OLA (see, e.g., U.S. Pat. No. 4,988,617). In this method, one probe hybridizes to a segment of a target nucleic acid with its 3' most end aligned with the SNP site. A second probe hybridizes to an adjacent segment of the target nucleic acid molecule directly 3' to the first probe. The two juxtaposed probes hybridize to the target nucleic acid molecule, and are ligated in the presence of a linking agent such as a ligase if there is perfect complementarity between the 3' most nucleotide of the first probe with the SNP site. If there is a mismatch, ligation would not occur. After the reaction, the ligated probes are separated from the target nucleic acid molecule, and detected as indicators of the presence of a SNP.

The following patents, patent applications, and published international patent applications, which are all hereby incorporated by reference, provide additional information pertaining to techniques for carrying out various types of OLA. The following U.S. patents describe OLA strategies for performing SNP detection: Nos. 6,027,889; 6,268,148; 5,494,810; 5,830,711 and 6,054,564. WO 97/31256 and WO 00/56927 describe OLA strategies for performing SNP detection using universal arrays, wherein a zipcode sequence can be introduced into one of the hybridization probes, and the resulting product, or amplified product, hybridized to a universal zip code array. U.S. application US01/17329 (and 09/584,905) describes OLA (or LDR) followed by PCR, wherein zipcodes are incorporated into OLA probes, and amplified PCR products are determined by electrophoretic or universal zipcode array readout. U.S. applications 60/427,818, 60/445,636, and 60/445,494 describe SNPlex methods and software for multiplexed SNP detection using OLA followed by PCR, wherein zipcodes are incorporated into OLA probes, and amplified PCR products are hybridized with a zipchute reagent, and the identity of the SNP determined from electrophoretic readout of the zipchute. In some embodiments, OLA is carried out prior to PCR (or another method of nucleic acid amplification). In other embodiments, PCR (or another method of nucleic acid amplification) is carried out prior to OLA.

Another method for SNP genotyping is based on mass spectrometry. Mass spectrometry takes advantage of the unique mass of each of the four nucleotides of DNA. SNPs can be unambiguously genotyped by mass spectrometry by measuring the differences in the mass of nucleic acids having alternative SNP alleles. MALDI-TOF (Matrix Assisted Laser Desorption Ionization—Time of Flight) mass spectrometry technology is preferred for extremely precise determinations of molecular mass, such as SNPs. Numerous approaches to SNP analysis have been developed based on mass spectrometry. Preferred mass spectrometry-based methods of SNP genotyping include primer extension assays, which can also be utilized in combination with other approaches, such as traditional gel-based formats and microarrays.

Typically, the primer extension assay involves designing and annealing a primer to a template PCR amplicon upstream (5') from a target SNP position. A mix of dideoxynucleotide triphosphates (ddNTPs) and/or deoxynucleotide triphosphates (dNTPs) are added to a reaction mixture containing template (e.g., a SNP-containing nucleic acid molecule which has typically been amplified, such as by PCR), primer, and DNA polymerase. Extension of the primer terminates at the first position in the template where a nucleotide complementary to one of the ddNTPs in the mix occurs. The primer can be either immediately adjacent (i.e., the nucleotide at the 3' end of the primer hybridizes to the nucleotide next to the target SNP site) or two or more nucleotides removed from the SNP position. If the primer is several nucleotides removed from the target SNP position, the only limitation is that the template sequence between the 3' end of the primer and the SNP position cannot contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide upstream from the SNP position (i.e., the nucleotide at the 3' end of the primer hybridizes to the nucleotide that is immediately adjacent to the target SNP site on the 5' side of the target SNP site). Extension by only one nucleotide is preferable, as it minimizes the overall mass of the extended primer, thereby increasing the resolution of mass differences between alternative SNP nucleotides. Furthermore, mass-tagged ddNTPs can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers can then be purified and analyzed by MALDI-TOF mass spectrometry to determine the identity of the nucleotide present at the target SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule. Ions with smaller m/z travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position. For further information regarding the use of primer extension assays in conjunction with MALDI-TOF mass spectrometry for SNP genotyping, see, e.g., Wise et al., "A standard protocol for single nucleotide primer extension in the human genome using matrix-assisted laser desorption/ionization time-of-flight mass spectrometry," *Rapid Commun Mass Spectrom* 17 (11):1195-202 (2003).

The following references provide further information describing mass spectrometry-based methods for SNP genotyping: Bocker, "SNP and mutation discovery using base-specific cleavage and MALDI-TOF mass spectrometry," *Bioinformatics* 19 Suppl 1:144-153 (July 2003); Storm et al., "MALDI-TOF mass spectrometry-based SNP genotyping," *Methods Mol Biol* 212:241-62 (2003); Jurinke et al., "The use of Mass ARRAY technology for high throughput genotyping," *Adv Biochem Eng Biotechnol* 77:57-74 (2002); and Jurinke et al., "Automated genotyping using the DNA MassArray technology," *Methods Mol Biol* 187:179-92 (2002).

SNPs can also be scored by direct DNA sequencing. A variety of automated sequencing procedures can be utilized (e.g. *Biotechniques* 19:448 (1995)), including sequencing by mass spectrometry. See, e.g., PCT International Publication No. WO 94/16101; Cohen et al., *Adv Chromatogr* 36:127-162 (1996); and Griffin et al, *Appl Biochem Biotechnol* 38:147-159 (1993). The nucleic acid sequences of the present invention enable one of ordinary skill in the art to readily design sequencing primers for such automated sequencing procedures. Commercial instrumentation, such as the Applied Biosystems 377, 3100, 3700, 3730, and 3730xl DNA Analyzers (Foster City, Calif.), is commonly used in the art for automated sequencing.

Other methods that can be used to genotype the SNPs of the present invention include single-strand conformational polymorphism (SSCP), and denaturing gradient gel electrophoresis (DGGE). Myers et al., *Nature* 313:495 (1985). SSCP identifies base differences by alteration in electrophoretic migration of single stranded PCR products, as described in Orita et al., *Proc. Nat. Acad.* Single-stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel. *PCR Technology: Principles and Applications for DNA Amplification* Chapter 7, Erlich, ed., W.H. Freeman and Co, N.Y. (1992).

Sequence-specific ribozymes (U.S. Pat. No. 5,498,531) can also be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis.

SNP genotyping can include the steps of, for example, collecting a biological sample from a human subject (e.g., sample of tissues, cells, fluids, secretions, etc.), isolating nucleic acids (e.g., genomic DNA, mRNA or both) from the cells of the sample, contacting the nucleic acids with one or more primers which specifically hybridize to a region of the isolated nucleic acid containing a target SNP under conditions such that hybridization and amplification of the target nucleic acid region occurs, and determining the nucleotide present at the SNP position of interest, or, in some assays, detecting the presence or absence of an amplification product (assays can be designed so that hybridization and/or amplification will only occur if a particular SNP allele is present or absent). In some assays, the size of the amplification product is detected and compared to the length of a control sample; for example, deletions and insertions can be detected by a change in size of the amplified product compared to a normal genotype.

SNP genotyping is useful for numerous practical applications, as described below. Examples of such applications include, but are not limited to, SNP-disease association analysis, disease predisposition screening, disease diagnosis, disease prognosis, disease progression monitoring, determining therapeutic strategies based on an individual's genotype ("pharmacogenomics"), developing therapeutic agents based on SNP genotypes associated with a disease or likelihood of responding to a drug, stratifying patient populations for clinical trials of a therapeutic, preventive, or diagnostic agent, predicting the likelihood that an individual will experience toxic side effects from a therapeutic agent, and human identification applications such as forensics.

Analysis of Genetic Associations between SNPs and Phenotypic Traits

SNP genotyping for disease diagnosis, disease predisposition screening, disease prognosis, determining drug responsiveness (pharmacogenomics), drug toxicity screening, and other uses described herein, typically relies on initially establishing a genetic association between one or more specific SNPs and the particular phenotypic traits of interest.

Different study designs may be used for genetic association studies. *Modern Epidemiology* 609-622, Lippincott, Williams & Wilkins (1998). Observational studies are most frequently carried out in which the response of the patients is not interfered with. The first type of observational study identifies a sample of persons in whom the suspected cause of the disease is present and another sample of persons in whom the suspected cause is absent, and then the frequency of development of disease in the two samples is compared. These sampled populations are called cohorts, and the study is a prospective study. The other type of observational study is case-control or a retrospective study. In typical case-control studies, samples are collected from individuals with the phenotype of interest (cases) such as certain manifestations of a disease, and from individuals without the phenotype (controls) in a population (target population) that conclusions are to be drawn from. Then the possible causes of the disease are investigated retrospectively. As the time and costs of collecting samples in case-control studies are considerably less than those for prospective studies, case-control studies are the more commonly used study design in genetic association studies, at least during the exploration and discovery stage.

In both types of observational studies, there may be potential confounding factors that should be taken into consideration. Confounding factors are those that are associated with both the real cause(s) of the disease and the disease itself, and they include demographic information such as age, gender, ethnicity as well as environmental factors. When confounding factors are not matched in cases and controls in a study, and are not controlled properly, spurious association results can arise. If potential confounding factors are identified, they should be controlled for by analysis methods explained below.

In a genetic association study, the cause of interest to be tested is a certain allele or a SNP or a combination of alleles or a haplotype from several SNPs. Thus, tissue specimens (e.g., whole blood) from the sampled individuals may be collected and genomic DNA genotyped for the SNP(s) of interest. In addition to the phenotypic trait of interest, other information such as demographic (e.g., age, gender, ethnicity, etc.), clinical, and environmental information that may influence the outcome of the trait can be collected to further characterize and define the sample set. In many cases, these factors are known to be associated with diseases and/or SNP allele frequencies. There are likely gene-environment and/or gene-gene interactions as well. Analysis methods to address gene-environment and gene-gene interactions (for example, the effects of the presence of both susceptibility alleles at two different genes can be greater than the effects of the individual alleles at two genes combined) are discussed below.

After all the relevant phenotypic and genotypic information has been obtained, statistical analyses are carried out to determine if there is any significant correlation between the presence of an allele or a genotype with the phenotypic characteristics of an individual. Preferably, data inspection and cleaning are first performed before carrying out statistical tests for genetic association. Epidemiological and clinical data of the samples can be summarized by descriptive statistics with tables and graphs. Data validation is preferably performed to check for data completion, inconsistent entries, and outliers. Chi-squared tests and t-tests (Wilcoxon rank-sum tests if distributions are not normal) may then be used to check for significant differences between cases and controls for discrete and continuous variables, respectively. To ensure genotyping quality, Hardy-Weinberg disequilibrium tests can be performed on cases and controls separately. Significant deviation from Hardy-Weinberg equilibrium (HWE) in both cases and controls for individual markers can be indicative of genotyping errors. If HWE is violated in a majority of markers, it is indicative of population substructure that should be further investigated. Moreover, Hardy-Weinberg disequilibrium in cases only can indicate genetic association of the markers with the disease. B. Weir, *Genetic Data Analysis*, Sinauer (1990).

To test whether an allele of a single SNP is associated with the case or control status of a phenotypic trait, one skilled in the art can compare allele frequencies in cases and controls. Standard chi-squared tests and Fisher exact tests can be carried out on a 2×2 table (2 SNP alleles×2 outcomes in the categorical trait of interest). To test whether genotypes of a SNP are associated, chi-squared tests can be carried out on a 3×2 table (3 genotypes×2 outcomes). Score tests are also carried out for genotypic association to contrast the three genotypic frequencies (major homozygotes, heterozygotes and minor homozygotes) in cases and controls, and to look for trends using 3 different modes of inheritance, namely dominant (with contrast coefficients 2, −1, −1), additive or allelic (with contrast coefficients 1, 0, −1) and recessive (with contrast coefficients 1, 1, −2). Odds ratios for minor versus major alleles, and odds ratios for heterozygote and homozygote variants versus the wild type genotypes are calculated with the desired confidence limits, usually 95%.

In order to control for confounders and to test for interaction and effect modifiers, stratified analyses may be performed using stratified factors that are likely to be confounding, including demographic information such as age, ethnicity, and gender, or an interacting element or effect modifier, such as a known major gene (e.g., APOE for Alzheimer's disease or HLA genes for autoimmune diseases), or environmental factors such as smoking in lung cancer. Stratified association tests may be carried out using Cochran-Mantel-Haenszel tests that take into account the ordinal nature of genotypes with 0, 1, and 2 variant alleles. Exact tests by StatXact may also be performed when computationally possible. Another way to adjust for confounding effects and test for interactions is to perform stepwise multiple logistic regression analysis using statistical packages such as SAS or R. Logistic regression is a model-building technique in which the best fitting and most parsimonious model is built to describe the relation between the dichotomous outcome (for instance, getting a certain disease or not) and a set of independent variables (for instance, genotypes of different associated genes, and the associated demographic and environmental factors). The most common model is one in which the logit transformation of the odds ratios is expressed as a linear combination of the variables (main effects) and their cross-product terms (interactions). Hosmer and Lemeshow, *Applied Logistic Regression*, Wiley (2000). To test whether a certain variable or interaction is significantly associated with the outcome, coefficients in the model are first estimated and then tested for statistical significance of their departure from zero.

In addition to performing association tests one marker at a time, haplotype association analysis may also be performed to study a number of markers that are closely linked together. Haplotype association tests can have better power than genotypic or allelic association tests when the tested markers are not the disease-causing mutations themselves but are in linkage disequilibrium with such mutations. The test will even be more powerful if the disease is indeed caused by a combination of alleles on a haplotype (e.g., APOE is a haplotype formed by 2 SNPs that are very close to each other). In order to perform haplotype association effectively, marker-marker linkage disequilibrium measures, both D' and $r^2$, are typically calculated for the markers within a gene to elucidate the haplotype structure. Recent studies in linkage disequilibrium indicate that SNPs within a gene are organized in block pattern, and a high degree of linkage disequilibrium exists within blocks and very little linkage disequilibrium exists between blocks. Daly et al, *Nature Genetics* 29:232-235 (2001). Haplotype association with the disease status can be performed using such blocks once they have been elucidated.

Haplotype association tests can be carried out in a similar fashion as the allelic and genotypic association tests. Each haplotype in a gene is analogous to an allele in a multi-allelic marker. One skilled in the art can either compare the haplotype frequencies in cases and controls or test genetic association with different pairs of haplotypes. It has been proposed that score tests can be done on haplotypes using the program "haplo.score." Schaid et al, *Am J Hum Genet* 70:425-434 (2002). In that method, haplotypes are first inferred by EM algorithm and score tests are carried out with a generalized linear model (GLM) framework that allows the adjustment of other factors.

An important decision in the performance of genetic association tests is the determination of the significance level at which significant association can be declared when the P value of the tests reaches that level. In an exploratory analysis where positive hits will be followed up in subsequent confirmatory testing, an unadjusted P value<0.2 (a significance level on the lenient side), for example, may be used for generating hypotheses for significant association of a SNP with certain phenotypic characteristics of a disease. It is preferred that a p-value<0.05 (a significance level traditionally used in the art) is achieved in order for a SNP to be considered to have an association with a disease. It is more preferred that a p-value<0.01 (a significance level on the stringent side) is achieved for an association to be declared. When hits are followed up in confirmatory analyses in more samples of the same source or in different samples from different sources, adjustment for multiple testing will be performed as to avoid excess number of hits while maintaining the experiment-wide error rates at 0.05. While there are different methods to adjust for multiple testing to control for different kinds of error rates, a commonly used but rather conservative method is Bonferroni correction to control the experiment-wise or family-wise error rate. Westfall et al., *Multiple comparisons and multiple tests*, SAS Institute (1999). Permutation tests to control for the false discovery rates, FDR, can be more powerful. Benjamini and Hochberg, *Journal of the Royal Statistical Society*, Series B 57:1289-1300 (1995); Westfall and Young, *Resampling-based Multiple Testing*, Wiley (1993). Such methods to control for multiplicity would be preferred when the tests are dependent and controlling for false discovery rates is sufficient as opposed to controlling for the experiment-wise error rates.

In replication studies using samples from different populations after statistically significant markers have been identified in the exploratory stage, meta-analyses can then be performed by combining evidence of different studies. *Modern Epidemiology* 643-673, Lippincott, Williams & Wilkins (1998). If available, association results known in the art for the same SNPs can be included in the meta-analyses.

Since both genotyping and disease status classification can involve errors, sensitivity analyses may be performed to see how odds ratios and p-values would change upon various estimates on genotyping and disease classification error rates.

It has been well known that subpopulation-based sampling bias between cases and controls can lead to spurious results in case-control association studies when prevalence of the disease is associated with different subpopulation groups. Ewens and Spielman, *Am J Hum Genet* 62:450-458 (1995). Such bias can also lead to a loss of statistical power in genetic association studies. To detect population stratification, Pritchard and Rosenberg suggested typing markers that are unlinked to the disease and using results of association tests on those markers to determine whether there is any population stratification. Pritchard et al., *Am J Hum Gen* 65:220-228 (1999). When stratification is detected, the genomic control (GC) method as proposed by Devlin and Roeder can be used to adjust for the inflation of test statistics due to population stratification. Devlin et al., *Biometrics* 55:997-1004 (1999). The GC method is robust to changes in population structure levels as well as being applicable to DNA pooling designs. Devlin et al., *Genet Epidem* 21:273-284 (2001).

While Pritchard's method recommended using 15-20 unlinked microsatellite markers, it suggested using more than 30 biallelic markers to get enough power to detect population stratification. For the GC method, it has been shown that about 60-70 biallelic markers are sufficient to estimate the inflation factor for the test statistics due to population stratification. Bacanu et al., *Am J Hum Genet* 66:1933-1944 (2000). Hence, 70 intergenic SNPs can be chosen in unlinked regions as indicated in a genome scan. Kehoe et al., *Hum Mol Genet* 8:237-245 (1999).

Once individual risk factors, genetic or non-genetic, have been found for the predisposition to disease, the next step is to set up a classification/prediction scheme to predict the category (for instance, disease or no-disease) that an individual will be in depending on his genotypes of associated SNPs and other non-genetic risk factors. Logistic regression for discrete trait and linear regression for continuous trait are standard techniques for such tasks. Draper and Smith, *Applied Regression Analysis*, Wiley (1998). Moreover, other techniques can also be used for setting up classification. Such techniques include, but are not limited to, MART, CART, neural network, and discriminant analyses that are suitable for use in comparing the performance of different methods. *The Elements of Statistical Learning*, Hastie, Tibshirani & Friedman, Springer (2002).

Disease Diagnosis and Predisposition Screening

Information on association/correlation between genotypes and disease-related phenotypes can be exploited in several ways. For example, in the case of a highly statistically significant association between one or more SNPs with predisposition to a disease for which treatment is available, detection of such a genotype pattern in an individual may justify immediate administration of treatment, or at least the institution of regular monitoring of the individual. Detection of the susceptibility alleles associated with serious disease in a couple contemplating having children may also be valuable to the couple in their reproductive decisions. In the case of a weaker but still statistically significant association between a SNP and a human disease, immediate therapeutic intervention or monitoring may not be justified after detecting the susceptibility allele or SNP. Nevertheless, the subject can be motivated to begin simple life-style changes (e.g., diet, exercise) that can be accomplished at little or no cost to the individual but would confer potential benefits in reducing the risk of developing conditions for which that individual may have an increased risk by virtue of having the risk allele(s).

The SNPs of the invention may contribute to the development of CVD (e.g., CHD, such as MI, or hypertension), or to responsiveness of an individual to a therapeutic treatment, in different ways. Some polymorphisms occur within a protein coding sequence and contribute to disease phenotype by affecting protein structure. Other polymorphisms occur in noncoding regions but may exert phenotypic effects indirectly via influence on, for example, replication, transcription, and/or translation. A single SNP may affect more than one phenotypic trait. Likewise, a single phenotypic trait may be affected by multiple SNPs in different genes.

As used herein, the terms "diagnose," "diagnosis," and "diagnostics" include, but are not limited to, any of the following: detection of CVD (such as CHD, e.g. MI, or hypertension) that an individual may presently have, predisposition/susceptibility/predictive screening (i.e., determining whether an individual has an increased or decreased risk of developing CVD in the future), prognosing the future course of CVD or recurrence of CVD in an individual, determining a particular type or subclass of CVD in an individual who currently or previously had CVD, confirming or reinforcing a previously made diagnosis of CVD, evaluating an individual's likelihood of responding positively to a particular treatment or therapeutic agent (particularly treatment or prevention of CVD), determining or selecting a therapeutic or preventive strategy that an individual is most likely to positively respond to (e.g., selecting a particular therapeutic agent or combination of therapeutic agents, or determining a dosing regimen, etc.), classifying (or confirming/reinforcing) an individual as a responder/non-responder (or determining a particular subtype of responder/non-responder) with respect to the individual's response to a drug treatment, and predicting whether a patient is likely to experience toxic effects from a particular treatment or therapeutic compound. Such diagnostic uses can be based on the SNPs individually or in a unique combination or SNP haplotypes of the present invention.

Haplotypes are particularly useful in that, for example, fewer SNPs can be genotyped to determine if a particular genomic region harbors a locus that influences a particular phenotype, such as in linkage disequilibrium-based SNP association analysis.

Linkage disequilibrium (LD) refers to the co-inheritance of alleles (e.g., alternative nucleotides) at two or more different SNP sites at frequencies greater than would be expected from the separate frequencies of occurrence of each allele in a given population. The expected frequency of co-occurrence of two alleles that are inherited independently is the frequency of the first allele multiplied by the frequency of the second allele. Alleles that co-occur at expected frequencies are said to be in "linkage equilibrium." In contrast, LD refers to any non-random genetic association between allele(s) at two or more different SNP sites, which is generally due to the physical proximity of the two loci along a chromosome. LD can occur when two or more SNPs sites are in close physical proximity to each other on a given chromosome and therefore alleles at these SNP sites will tend to remain unseparated for multiple generations with the consequence that a particular nucleotide (allele) at one SNP site will show a non-random association with a particular nucleotide (allele) at a different SNP site located nearby. Hence, genotyping one of the SNP sites will give almost the same information as genotyping the other SNP site that is in LD.

Various degrees of LD can be encountered between two or more SNPs with the result being that some SNPs are more closely associated (i.e., in stronger LD) than others. Furthermore, the physical distance over which LD extends along a chromosome differs between different regions of the genome, and therefore the degree of physical separation between two or more SNP sites necessary for LD to occur can differ between different regions of the genome.

For diagnostic purposes and similar uses, if a particular SNP site is found to be useful for, for example, predicting an individual's susceptibility to CVD or an individual's response to a treatment, then the skilled artisan would recognize that other SNP sites which are in LD with this SNP site would also be useful for the same purposes. Thus, polymorphisms (e.g., SNPs and/or haplotypes) that are not the actual disease-causing (causative) polymorphisms, but are in LD with such causative polymorphisms, are also useful. In such instances, the genotype of the polymorphism(s) that is/are in LD with the causative polymorphism is predictive of the genotype of the causative polymorphism and, consequently, predictive of the phenotype (e.g., CVD, or responder/non-responder to a drug treatment) that is influenced by the causative SNP(s). Therefore, polymorphic markers that are in LD with causative polymorphisms are useful as diagnostic markers, and are particularly useful when the actual causative polymorphism(s) is/are unknown.

Examples of polymorphisms that can be in LD with one or more causative polymorphisms (and/or in LD with one or more polymorphisms that have a significant statistical association with a condition) and therefore useful for diagnosing the same condition that the causative/associated SNP(s) is used to diagnose, include other SNPs in the same gene, protein-coding, or mRNA transcript-coding region as the causative/associated SNP, other SNPs in the same exon or same intron as the causative/associated SNP, other SNPs in the same haplotype block as the causative/associated SNP, other SNPs in the same intergenic region as the causative/associated SNP, SNPs that are outside but near a gene (e.g., within 6 kb on either side, 5' or 3', of a gene boundary) that harbors a causative/associated SNP, etc. Such useful LD SNPs can be selected from among the SNPs disclosed in Tables 1 and 2, for example.

Linkage disequilibrium in the human genome is reviewed in Wall et al., "Haplotype blocks and linkage disequilibrium in the human genome," *Nat Rev Genet* 4 (8):587-97 (August 2003); Garner et al., "On selecting markers for association studies: patterns of linkage disequilibrium between two and three diallelic loci," *Genet Epidemiol* 24 (1):57-67 (January 2003); Ardlie et al., "Patterns of linkage disequilibrium in the human genome," *Nat Rev Genet* 3 (4):299-309 (April 2002); erratum in *Nat Rev Genet* 3 (7):566 (July 2002); and Remm et al., "High-density genotyping and linkage disequilibrium in the human genome using chromosome 22 as a model," *Curr Opin Chem Biol* 6 (1):24-30 (February 2002); J. B. S. Haldane, "The combination of linkage values, and the calculation of distances between the loci of linked factors," *J Genet* 8:299-309 (1919); G. Mendel, *Versuche über Pflanzen-Hybriden. Verhandlungen des naturforschenden Vereines in Brünn* (*Proceedings of the Natural History Society of Brünn*) (1866); *Genes IV*, B. Lewin, ed., Oxford University Press, N.Y. (1990); D. L. Hartl and A. G. Clark *Principles of Population Genetics* $2^{nd}$ ed., Sinauer Associates, Inc., Mass. (1989); J. H. Gillespie *Population Genetics: A Concise Guide.* $2^{nd}$ nd ed., Johns Hopkins University Press (2004); R. C. Lewontin, "The interaction of selection and linkage. I. General considerations; heterotic models," *Genetics* 49:49-67 (1964); P. G. Hoel, *Introduction to Mathematical Statistics* $2^{nd}$ ed., John Wiley & Sons, Inc., N.Y. (1954); R. R. Hudson, "Two-locus sampling distributions and their application," *Genetics* 159:1805-1817 (2001); A. P. Dempster, N. M. Laird, D. B. Rubin, "Maximum likelihood from incomplete data via the EM algorithm," *J R Stat Soc* 39:1-38 (1977); L. Excoffier, M. Slatkin, "Maximum-likelihood estimation of molecular haplotype frequencies in a diploid population," *Mol Biol Evol* 12 (5):921-927 (1995); D. A. Tregouet, S. Escolano, L. Tiret, A. Mallet, J. L. Golmard, "A new algorithm for haplotype-based association analysis: the Stochastic-EM algorithm," *Ann Hum Genet* 68 (Pt 2):165-177 (2004); A. D. Long and C. H. Langley C H, "The power of association studies to detect the contribution of candidate genetic loci to variation in complex traits," *Genome Research* 9:720-731 (1999); A. Agresti, *Categorical Data Analysis*, John Wiley & Sons, Inc., N.Y.

(1990); K. Lange, *Mathematical and Statistical Methods for Genetic Analysis*, Springer-Verlag New York, Inc., N.Y. (1997); The International HapMap Consortium, "The International HapMap Project," *Nature* 426:789-796 (2003); The International HapMap Consortium, "A haplotype map of the human genome," *Nature* 437:1299-1320 (2005); G. A. Thorisson, A. V. Smith, L. Krishnan, L. D. Stein, "The International HapMap Project Web Site," *Genome Research* 15:1591-1593 (2005); G. McVean, C. C. A. Spencer, R. Chaix, "Perspectives on human genetic variation from the HapMap project," *PLoS Genetics* 1 (4):413-418 (2005); J. N. Hirschhorn, M. J. Daly, "Genome-wide association studies for common diseases and complex traits," *Nat Genet* 6:95-108 (2005); S. J. Schrodi, "A probabilistic approach to large-scale association scans: a semi-Bayesian method to detect disease-predisposing alleles," *SAGMB* 4 (1):31 (2005); W. Y. S. Wang, B. J. Barratt, D. G. Clayton, J. A. Todd, "Genome-wide association studies: theoretical and practical concerns," *Nat Rev Genet* 6:109-118 (2005); J. K. Pritchard, M. Przeworski, "Linkage disequilibrium in humans: models and data," *Am J Hum Genet* 69:1-14 (2001).

As discussed above, one aspect of the present invention is the discovery that SNPs that are in certain LD distance with an interrogated SNP can also be used as valid markers for determining whether an individual has an increased or decreased risk of having or developing CVD, for example. As used herein, the term "interrogated SNP" refers to SNPs that have been found to be associated with an increased or decreased risk of disease using genotyping results and analysis, or other appropriate experimental method as exemplified in the working examples described in this application. As used herein, the term "LD SNP" refers to a SNP that has been characterized as a SNP associating with an increased or decreased risk of diseases due to their being in LD with the "interrogated SNP" under the methods of calculation described in the application. Below, applicants describe the methods of calculation with which one of ordinary skilled in the art may determine if a particular SNP is in LD with an interrogated SNP. The parameter $r^2$ is commonly used in the genetics art to characterize the extent of linkage disequilibrium between markers (Hudson, 2001). As used herein, the term "in LD with" refers to a particular SNP that is measured at above the threshold of a parameter such as $r^2$ with an interrogated SNP.

It is now common place to directly observe genetic variants in a sample of chromosomes obtained from a population. Suppose one has genotype data at two genetic markers located on the same chromosome, for the markers A and B. Further suppose that two alleles segregate at each of these two markers such that alleles $A_1$ and $A_2$ can be found at marker A and alleles $B_1$ and $B_2$ at marker B. Also assume that these two markers are on a human autosome. If one is to examine a specific individual and find that they are heterozygous at both markers, such that their two-marker genotype is $A_1A_2B_1B_2$, then there are two possible configurations: the individual in question could have the alleles $A_1B_1$ on one chromosome and $A_2B_2$ on the remaining chromosome; alternatively, the individual could have alleles $A_1B_2$ on one chromosome and $A_2B_1$ on the other. The arrangement of alleles on a chromosome is called a haplotype. In this illustration, the individual could have haplotypes $A_1B_1/A_2B_2$ or $A_1B_2/A_2B_1$ (see Hartl and Clark (1989) for a more complete description). The concept of linkage equilibrium relates the frequency of haplotypes to the allele frequencies.

Assume that a sample of individuals is selected from a larger population. Considering the two markers described above, each having two alleles, there are four possible haplotypes: $A_1B_1$, $A_1B_2$, $A_2B_1$ and $A_2B_2$. Denote the frequencies of these four haplotypes with the following notation.

$$P_{11} = \text{freq}(A_1B_1) \tag{1}$$

$$P_{12} = \text{freq}(A_1B_2) \tag{2}$$

$$P_{21} = \text{freq}(A_2B_1) \tag{3}$$

$$P_{22} = \text{freq}(A_2B_2) \tag{4}$$

The allele frequencies at the two markers are then the sum of different haplotype frequencies, it is straightforward to write down a similar set of equations relating single-marker allele frequencies to two-marker haplotype frequencies:

$$p_1 = \text{freq}(A_1) = P_{11} + P_{12} \tag{5}$$

$$p_2 = \text{freq}(A_2) = P_{21} + P_{22} \tag{6}$$

$$q_1 = \text{freq}(B_1) = P_{11} + P_{21} \tag{7}$$

$$q_2 = \text{freq}(B_2) = P_{12} + P_{22} \tag{8}$$

Note that the four haplotype frequencies and the allele frequencies at each marker must sum to a frequency of 1.

$$P_{11} + P_{12} + P_{21} + P_{22} = 1 \tag{9}$$

$$p_1 + p_2 = 1 \tag{10}$$

$$q_1 + q_2 = 1 \tag{11}$$

If there is no correlation between the alleles at the two markers, one would expect that the frequency of the haplotypes would be approximately the product of the composite alleles. Therefore, $$P_{11} \approx p_1 q_2 \tag{12}$$

$$P_{12} \approx p_1 q_2 \tag{13}$$

$$P_{21} \approx p_2 q_1 \tag{14}$$

$$P_{22} \approx p_2 q_2 \tag{15}$$

These approximating equations (12)-(15) represent the concept of linkage equilibrium where there is independent assortment between the two markers—the alleles at the two markers occur together at random. These are represented as approximations because linkage equilibrium and linkage disequilibrium are concepts typically thought of as properties of a sample of chromosomes; and as such they are susceptible to stochastic fluctuations due to the sampling process. Empirically, many pairs of genetic markers will be in linkage equilibrium, but certainly not all pairs.

Having established the concept of linkage equilibrium above, applicants can now describe the concept of linkage disequilibrium (LD), which is the deviation from linkage equilibrium. Since the frequency of the $A_1B_1$ haplotype is approximately the product of the allele frequencies for $A_1$ and $B_1$ under the assumption of linkage equilibrium as stated mathematically in (12), a simple measure for the amount of departure from linkage equilibrium is the difference in these two quantities, D, $$D = P_{11} - p_1 q_1 \tag{16}$$

D=0 indicates perfect linkage equilibrium. Substantial departures from D=0 indicates LD in the sample of chromosomes examined. Many properties of D are discussed in Lewontin (1964) including the maximum and minimum values that D can take. Mathematically, using basic algebra, it can be shown that D can also be written solely in terms of haplotypes:

$$D = P_{11}P_{22} - P_{12}P_{21} \quad (17)$$

If one transforms D by squaring it and subsequently dividing by the product of the allele frequencies of $A_1$, $A_2$, $B_1$ and $B_2$, the resulting quantity, called $r^2$, is equivalent to the square of the Pearson's correlation coefficient commonly used in statistics (e.g. Hoel, 1954).

$$r^2 = \frac{D^2}{p_1 p_2 q_1 q_2} \quad (18)$$

As with D, values of $r^2$ close to 0 indicate linkage equilibrium between the two markers examined in the sample set. As values of $r^2$ increase, the two markers are said to be in linkage disequilibrium. The range of values that $r^2$ can take are from 0 to 1. $r^2=1$ when there is a perfect correlation between the alleles at the two markers.

In addition, the quantities discussed above are sample-specific. And as such, it is necessary to formulate notation specific to the samples studied. In the approach discussed here, three types of samples are of primary interest: (i) a sample of chromosomes from individuals affected by a disease-related phenotype (cases), (ii) a sample of chromosomes obtained from individuals not affected by the disease-related phenotype (controls), and (iii) a standard sample set used for the construction of haplotypes and calculation pairwise linkage disequilibrium. For the allele frequencies used in the development of the method described below, an additional subscript will be added to denote either the case or control sample sets.

$$p_{1,cs} = \text{freq}(A_1 \text{ in cases}) \quad (19)$$

$$p_{2,cs} = \text{freq}(A_2 \text{ in cases}) \quad (20)$$

$$q_{1,cs} = \text{freq}(B_1 \text{ in cases}) \quad (21)$$

$$q_{2,cs} = \text{freq}(B_2 \text{ in cases}) \quad (22)$$

Similarly, $$p_{1,ct} = \text{freq}(A_1 \text{ in controls}) \quad (23)$$

$$p_{2,ct} = \text{freq}(A_2 \text{ in controls}) \quad (24)$$

$$q_{1,ct} = \text{freq}(B_1 \text{ in controls}) \quad (25)$$

$$q_{2,ct} = \text{freq}(B_2 \text{ in controls}) \quad (26)$$

As a well-accepted sample set is necessary for robust linkage disequilibrium calculations, data obtained from the International HapMap project (The International HapMap Consortium 2003, 2005; Thorisson et al, 2005; McVean et al, 2005) can be used for the calculation of pairwise $r^2$ values. Indeed, the samples genotyped for the International HapMap Project were selected to be representative examples from various human sub-populations with sufficient numbers of chromosomes examined to draw meaningful and robust conclusions from the patterns of genetic variation observed. The International HapMap project website (hapmap.org) contains a description of the project, methods utilized and samples examined. It is useful to examine empirical data to get a sense of the patterns present in such data.

Haplotype frequencies were explicit arguments in equation (18) above. However, knowing the 2-marker haplotype frequencies requires that phase to be determined for doubly heterozygous samples. When phase is unknown in the data examined, various algorithms can be used to infer phase from the genotype data. This issue was discussed earlier where the doubly heterozygous individual with a 2-SNP genotype of $A_1A_2B_1B_2$ could have one of two different sets of chromosomes: $A_1B_1/A_2B_2$ or $A_1B_2/A_2B_1$. One such algorithm to estimate haplotype frequencies is the expectation-maximization (EM) algorithm first formalized by Dempster et al. (1977). This algorithm is often used in genetics to infer haplotype frequencies from genotype data (e.g. Excoffier and Slatkin (1995); Tregouet et al. (2004)). It should be noted that for the two-SNP case explored here, EM algorithms have very little error provided that the allele frequencies and sample sizes are not too small. The impact on $r^2$ values is typically negligible.

As correlated genetic markers share information, interrogation of SNP markers in LD with a disease-associated SNP marker can also have sufficient power to detect disease association (Long and Langley (1999)). The relationship between the power to directly find disease-associated alleles and the power to indirectly detect disease-association was investigated by Pritchard and Przeworski (2001). In a straight-forward derivation, it can be shown that the power to detect disease association indirectly at a marker locus in linkage disequilibrium with a disease-association locus is approximately the same as the power to detect disease-association directly at the disease-association locus if the sample size is increased by a factor of $$\frac{1}{r^2}$$

(the reciprocal of equation 18) at the marker in comparison with the disease-association locus.

Therefore, if one calculated the power to detect disease-association indirectly with an experiment having N samples, then equivalent power to directly detect disease-association (at the actual disease-susceptibility locus) would necessitate an experiment using approximately $r^2N$ samples. This elementary relationship between power, sample size and linkage disequilibrium can be used to derive an $r^2$ threshold value useful in determining whether or not genotyping markers in linkage disequilibrium with a SNP marker directly associated with disease status has enough power to indirectly detect disease-association.

To commence a derivation of the power to detect disease-associated markers through an indirect process, define the effective chromosomal sample size as $$n = \frac{4N_{cs}N_{ct}}{N_{cs} + N_{ct}}; \quad (27)$$

where $N_{cs}$ and $N_{ct}$ are the numbers of diploid cases and controls, respectively. This is necessary to handle situations where the numbers of cases and controls are not equivalent. For equal case and control sample sizes, $N_{cs}+N_{ct}=N$, the value of the effective number of chromosomes is simply $n=2N$—as expected. Let power be calculated for a significance level $\alpha$ (such that traditional P-values below $\alpha$ will be deemed statistically significant). Define the standard Gaussian distribution function as $\Phi(\bullet)$. Mathematically, $$\Phi(x) = \frac{1}{\sqrt{2\pi}} \int_{-\infty}^{x} e^{-\frac{\theta^2}{2}} d\theta \quad (28)$$

Alternatively, the following error function notation (Erf) may also be used, $$\Phi(x) = \frac{1}{2}\left[1 + \text{Erf}\left(\frac{x}{\sqrt{2}}\right)\right] \quad (29)$$

For example, $\Phi(1.644854)=0.95$. The value of $r^2$ may be derived to yield a pre-specified minimum amount of power to detect disease association though indirect interrogation. Noting that the LD SNP marker could be the one that is carrying the disease-association allele, therefore that this approach constitutes a lower-bound model where all indirect power results are expected to be at least as large as those interrogated.

Denote by $\beta$ the error rate for not detecting truly disease-associated markers. Therefore, $1-\beta$, is the classical definition of statistical power. Substituting the Pritchard-Pzreworski result into the sample size, the power to detect disease association at a significance level of $\alpha$ is given by the approximation $$1-\beta \cong \Phi\left[\frac{|q_{1,cs} - q_{1,ct}|}{\sqrt{\frac{q_{1,cs}(1-q_{1,cs}) + q_{1,ct}(1-q_{1,ct})}{r^2 n}}} - Z_{1-\frac{\alpha}{2}}\right]; \quad (30)$$

where $Z_u$ is the inverse of the standard normal cumulative distribution evaluated at u ($u\in(0,1)$). $Z_u = \Phi^{-1}(u)$, where $\Phi(\Phi^{-1}(u)) = \Phi^{-1}(\Phi(u)) = u$. For example, setting $\alpha=0.05$, and therefore $1-\alpha/2=0.975$, one obtains $Z_{0.975}=1.95996$. Next, setting power equal to a threshold of a minimum power of T, $$T = \Phi\left[\frac{|q_{1,cs} - q_{1,ct}|}{\sqrt{\frac{q_{1,cs}(1-q_{1,cs}) + q_{1,ct}(1-q_{1,ct})}{r^2 n}}} - Z_{1-\frac{\alpha}{2}}\right] \quad (31)$$

and solving for $r^2$, the following threshold $r^2$ is obtained:

$$r_T^2 = \frac{[q_{1,cs}(1-q_{1,cs}) + q_{1,ct}(1-q_{1,ct})]}{n(q_{1,cs} - q_{1,ct})^2}\left[\Phi^{-1}(T) + Z_{1-\frac{\alpha}{2}}\right]^2 \quad (32)$$

Or, $$r_T^2 = \frac{(Z_T + Z_{1-\frac{\alpha}{2}})^2}{n}\left[\frac{q_{1,cs} - (q_{1,cs})^2 + q_{1,ct} - (q_{1,ct})^2}{(q_{1,cs} - q_{1,ct})^2}\right] \quad (33)$$

Suppose that $r^2$ is calculated between an interrogated SNP and a number of other SNPs with varying levels of LD with the interrogated SNP. The threshold value $r_T^2$ is the minimum value of linkage disequilibrium between the interrogated SNP and the potential LD SNPs such that the LD SNP still retains a power greater or equal to T for detecting disease-association. For example, suppose that SNP rs200 is genotyped in a case-control disease-association study and it is found to be associated with a disease phenotype. Further suppose that the minor allele frequency in 1,000 case chromosomes was found to be 16% in contrast with a minor allele frequency of 10% in 1,000 control chromosomes. Given those measurements one could have predicted, prior to the experiment, that the power to detect disease association at a significance level of 0.05 was quite high—approximately 98% using a test of allelic association. Applying equation (32) one can calculate a minimum value of $r^2$ to indirectly assess disease association assuming that the minor allele at SNP rs200 is truly disease-predisposing for a threshold level of power. If one sets the threshold level of power to be 80%, then $r_T^2=0.489$ given the same significance level and chromosome numbers as above. Hence, any SNP with a pairwise $r^2$ value with rs200 greater than 0.489 is expected to have greater than 80% power to detect the disease association. Further, this is assuming the conservative model where the LD SNP is disease-associated only through linkage disequilibrium with the interrogated SNP rs200.

The contribution or association of particular SNPs and/or SNP haplotypes with disease phenotypes, such as CVD, enables the SNPs of the present invention to be used to develop superior diagnostic tests capable of identifying individuals who express a detectable trait, such as CVD, as the result of a specific genotype, or individuals whose genotype places them at an increased or decreased risk of developing a detectable trait at a subsequent time as compared to individuals who do not have that genotype. As described herein, diagnostics may be based on a single SNP or a group of SNPs. Combined detection of a plurality of SNPs (for example, 2, 3, 4, 5, 6, 7, 8, 9, 10, 11, 12, 13, 14, 15, 16, 17, 18, 19, 20, 24, 25, 30, 32, 48, 50, 64, 96, 100, or any other number in-between, or more, of the SNPs provided in Table 1 and/or Table 2) typically increases the probability of an accurate diagnosis. For example, the presence of a single SNP known to correlate with CVD might indicate a probability of 20% that an individual has or is at risk of developing CVD, whereas detection of five SNPs, each of which correlates with CVD, might indicate a probability of 80% that an individual has or is at risk of developing CVD. To further increase the accuracy of diagnosis or predisposition screening, analysis of the SNPs of the present invention can be combined with that of other polymorphisms or other risk factors of CVD, such as disease symptoms, pathological characteristics, family history, diet, environmental factors or lifestyle factors.

It will be understood by practitioners skilled in the treatment or diagnosis of CVD that the present invention generally does not intend to provide an absolute identification of individuals who are at risk (or less at risk) of developing CVD, and/or pathologies related to CVD, but rather to indicate a certain increased (or decreased) degree or likelihood of developing the disease based on statistically significant association results. However, this information is extremely valuable as it can be used to, for example, initiate preventive treatments or to allow an individual carrying one or more significant SNPs or SNP haplotypes to foresee warning signs such as minor clinical symptoms, or to have regularly scheduled physical exams to monitor for appearance of a condition in order to identify and begin treatment of the condition at an early stage. Particularly with diseases that are extremely debilitating or fatal if not treated on time, the knowledge of a potential predisposition, even if this predisposition is not absolute, would likely contribute in a very significant manner to treatment efficacy.

The diagnostic techniques of the present invention may employ a variety of methodologies to determine whether a test subject has a SNP or a SNP pattern associated with an increased or decreased risk of developing a detectable trait or whether the individual suffers from a detectable trait as a result of a particular polymorphism/mutation, including, for example, methods which enable the analysis of individual chromosomes for haplotyping, family studies, single sperm DNA analysis, or somatic hybrids. The trait analyzed using the diagnostics of the invention may be any detectable trait that is commonly observed in pathologies and disorders related to CVD.

Another aspect of the present invention relates to a method of determining whether an individual is at risk (or less at risk) of developing one or more traits or whether an individual expresses one or more traits as a consequence of possessing a particular trait-causing or trait-influencing allele. These methods generally involve obtaining a nucleic acid sample from an individual and assaying the nucleic acid sample to determine which nucleotide(s) is/are present at one or more SNP positions, wherein the assayed nucleotide(s) is/are indicative of an increased or decreased risk of developing the trait or indicative that the individual expresses the trait as a result of possessing a particular trait-causing or trait-influencing allele.

In another embodiment, the SNP detection reagents of the present invention are used to determine whether an individual has one or more SNP allele(s) affecting the level (e.g., the concentration of mRNA or protein in a sample, etc.) or pattern (e.g., the kinetics of expression, rate of decomposition, stability profile, Km, Vmax, etc.) of gene expression (collectively, the "gene response" of a cell or bodily fluid). Such a determination can be accomplished by screening for mRNA or protein expression (e.g., by using nucleic acid arrays, RT-PCR, TaqMan assays, or mass spectrometry), identifying genes having altered expression in an individual, genotyping SNPs disclosed in Table 1 and/or Table 2 that could affect the expression of the genes having altered expression (e.g., SNPs that are in and/or around the gene(s) having altered expression, SNPs in regulatory/control regions, SNPs in and/or around other genes that are involved in pathways that could affect the expression of the gene(s) having altered expression, or all SNPs could be genotyped), and correlating SNP genotypes with altered gene expression. In this manner, specific SNP alleles at particular SNP sites can be identified that affect gene expression.

Therapeutics, Pharmacogenomics, and Drug Development
Therapeutic Methods and Compositions In certain aspects of the invention, there are provided methods of assaying (i.e., testing) one or more SNPs provided by the present invention in an individual's nucleic acids, and administering a therapeutic or preventive agent to the individual based on the allele(s) present at the SNP(s) having indicated that the individual can benefit from the therapeutic or preventive agent.

In further aspects of the invention, there are provided methods of assaying one or more SNPs provided by the present invention in an individual's nucleic acids, and administering a diagnostic agent (e.g., an imaging agent), or otherwise carrying out further diagnostic procedures on the individual, based on the allele(s) present at the SNP(s) having indicated that the diagnostic agents or diagnostics procedures are justified in the individual.

In yet other aspects of the invention, there is provided a pharmaceutical pack comprising a therapeutic agent (e.g., a small molecule drug, antibody, peptide, antisense or RNAi nucleic acid molecule, etc.) and a set of instructions for administration of the therapeutic agent to an individual who has been tested for one or more SNPs provided by the present invention.

Pharmacogenomics

The present invention provides methods for assessing the pharmacogenomics of a subject harboring particular SNP alleles or haplotypes to a particular therapeutic agent or pharmaceutical compound, or to a class of such compounds. Pharmacogenomics deals with the roles which clinically significant hereditary variations (e.g., SNPs) play in the response to drugs due to altered drug disposition and/or abnormal action in affected persons. See, e.g., Roses, Nature 405, 857-865 (2000); Gould Rothberg, Nature Biotechnology 19, 209-211 (2001); Eichelbaum, Clin Exp Pharmacol Physiol 23 (10-11):983-985 (1996); and Linder, Clin Chem 43 (2):254-266 (1997). The clinical outcomes of these variations can result in severe toxicity of therapeutic drugs in certain individuals or therapeutic failure of drugs in certain individuals as a result of individual variation in metabolism. Thus, the SNP genotype of an individual can determine the way a therapeutic compound acts on the body or the way the body metabolizes the compound. For example, SNPs in drug metabolizing enzymes can affect the activity of these enzymes, which in turn can affect both the intensity and duration of drug action, as well as drug metabolism and clearance.

The discovery of SNPs in drug metabolizing enzymes, drug transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic variants of a protein in which one or more of the protein functions in one population are different from those in another population. SNPs and the encoded variant peptides thus provide targets to ascertain a genetic predisposition that can affect treatment modality. For example, in a ligand-based treatment, SNPs may give rise to amino terminal extracellular domains and/or other ligand-binding regions of a receptor that are more or less active in ligand binding, thereby affecting subsequent protein activation. Accordingly, ligand dosage would necessarily be modified to maximize the therapeutic effect within a given population containing particular SNP alleles or haplotypes.

As an alternative to genotyping, specific variant proteins containing variant amino acid sequences encoded by alternative SNP alleles could be identified. Thus, pharmacogenomic characterization of an individual permits the selection of effective compounds and effective dosages of such compounds for prophylactic or therapeutic uses based on the individual's SNP genotype, thereby enhancing and optimizing the effectiveness of the therapy. Furthermore, the production of recombinant cells and transgenic animals containing particular SNPs/haplotypes allow effective clinical design and testing of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in predicting an individual's predisposition to CVD (e.g., CHD, such as MI, or hypertension) and in predicting an individual's responsiveness to a drug (particularly for treating or preventing CVD). Pharmacogenomic characterization of an individual, based on an individual's SNP genotype, can identify those individuals unlikely to respond to treatment with a particular medication and thereby allows physicians to avoid prescribing the ineffective medication to those individuals. On the other hand, SNP genotyping of an individual may enable physicians to select the appropriate medication and dosage regimen that will be most effective based on an individual's SNP genotype. This information increases a physician's confidence in prescribing medications and motivates patients to comply with their drug regimens. Furthermore, pharmacogenomics may identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et al., *Trends in Biotechnology*, August 2000). Thus, pharmacogenomics based on the SNPs disclosed herein has the potential to both save lives and reduce healthcare costs substantially.

Pharmacogenomics in general is discussed further in Rose et al., "Pharmacogenetic analysis of clinically relevant genetic polymorphisms," *Methods Mol Med* 85:225-37 (2003). Pharmacogenomics as it relates to Alzheimer's disease and other neurodegenerative disorders is discussed in Cacabelos, "Pharmacogenomics for the treatment of dementia," *Ann Med* 34 (5):357-79 (2002); Maimone et al., "Pharmacogenomics of neurodegenerative diseases," *Eur J Pharmacol* 413 (1): 11-29 (February 2001); and Poirier, "Apolipoprotein E: a pharmacogenetic target for the treatment of Alzheimer's disease," *Mol Diagn* 4 (4):335-41 (Dec. 1999). Pharmacogenomics as it relates to cardiovascular disorders is discussed in Siest et al., "Pharmacogenomics of drugs affecting the cardiovascular system," *Clin Chem Lab Med* 41 (4):590-9 (April 2003); Mukherjee et al., "Pharmacogenomics in cardiovascular diseases," *Prog Cardiovasc Dis* 44 (6):479-98 (May-June 2002); and Mooser et al., "Cardiovascular pharmacogenetics in the SNP era," *J Thromb Haemost* 1 (7):1398-402 (July 2003). Pharmacogenomics as it relates to cancer is discussed in McLeod et al., "Cancer pharmacogenomics: SNPs, chips, and the individual patient," *Cancer Invest* 21 (4):630-40 (2003); and Watters et al., "Cancer pharmacogenomics: current and future applications," *Biochim Biophys Acta* 1603 (2):99-111 (March 2003).

Clinical Trials

In certain aspects of the invention, there are provided methods of using the SNPs disclosed herein to identify or stratify patient populations for clinical trials of a therapeutic, preventive, or diagnostic agent.

For instance, an aspect of the present invention includes selecting individuals for clinical trials based on their SNP genotype, such as selecting individuals for inclusion in a clinical trial and/or assigning individuals to a particular group within a clinical trial (e.g., an "arm" or "cohort" of the trial). For example, individuals with SNP genotypes that indicate that they are likely to positively respond to a drug can be included in the trials, whereas those individuals whose SNP genotypes indicate that they are less likely to or would not respond to the drug, or who are at risk for suffering toxic effects or other adverse reactions, can be excluded from the clinical trials. This not only can improve the safety of clinical trials, but also can enhance the chances that the trial will demonstrate statistically significant efficacy.

Thus, certain embodiments of the invention provide methods for conducting a clinical trial of a therapeutic agent in which a human is selected for inclusion in the clinical trial and/or assigned to a particular group within a clinical trial based on the presence or absence of one or more SNPs disclosed herein. In certain embodiments, the therapeutic agent is a statin.

In certain exemplary embodiments, SNPs of the invention can be used to select individuals who are unlikely to respond positively to a particular therapeutic agent (or class of therapeutic agents) based on their SNP genotype(s) to participate in a clinical trial of another type of drug that may benefit them. Thus, in certain embodiments, the SNPs of the invention can be used to identify patient populations who do not adequately respond to current treatments and are therefore in need of new therapies. This not only benefits the patients themselves, but also benefits organizations such as pharmaceutical companies by enabling the identification of populations that represent markets for new drugs, and enables the efficacy of these new drugs to be tested during clinical trials directly in individuals within these markets.

The SNP-containing nucleic acid molecules of the present invention are also useful for monitoring the effectiveness of modulating compounds on the expression or activity of a variant gene, or encoded product, particularly in a treatment regimen or in clinical trials. Thus, the gene expression pattern can serve as an indicator for the continuing effectiveness of treatment with the compound, particularly with compounds to which a patient can develop resistance, as well as an indicator for toxicities. The gene expression pattern can also serve as a marker indicative of a physiological response of the affected cells to the compound. Accordingly, such monitoring would allow either increased administration of the compound or the administration of alternative compounds to which the patient has not become resistant.

Furthermore, the SNPs of the present invention may have utility in determining why certain previously developed drugs performed poorly in clinical trials and may help identify a subset of the population that would benefit from a drug that had previously performed poorly in clinical trials, thereby "rescuing" previously developed drugs, and enabling the drug to be made available to a particular CVD patient population that can benefit from it.

Identification, Screening, and Use of Therapeutic Agents

The SNPs of the present invention also can be used to identify novel therapeutic targets for CVD. For example, genes containing the disease-associated variants ("variant genes") or their products, as well as genes or their products that are directly or indirectly regulated by or interacting with these variant genes or their products, can be targeted for the development of therapeutics that, for example, treat the disease or prevent or delay disease onset. The therapeutics may be composed of, for example, small molecules, proteins, protein fragments or peptides, antibodies, nucleic acids, or their derivatives or mimetics which modulate the functions or levels of the target genes or gene products.

The invention further provides methods for identifying a compound or agent that can be used to treat CVD. The SNPs disclosed herein are useful as targets for the identification and/or development of therapeutic agents. A method for identifying a therapeutic agent or compound typically includes assaying the ability of the agent or compound to modulate the activity and/or expression of a SNP-containing nucleic acid or the encoded product and thus identifying an agent or a compound that can be used to treat a disorder characterized by undesired activity or expression of the SNP-containing nucleic acid or the encoded product. The assays can be performed in cell-based and cell-free systems. Cell-based assays can include cells naturally expressing the nucleic acid molecules of interest or recombinant cells genetically engineered to express certain nucleic acid molecules.

Variant gene expression in a CVD patient can include, for example, either expression of a SNP-containing nucleic acid sequence (for instance, a gene that contains a SNP can be transcribed into an mRNA transcript molecule containing the SNP, which can in turn be translated into a variant protein) or altered expression of a normal/wild-type nucleic acid sequence due to one or more SNPs (for instance, a regulatory/control region can contain a SNP that affects the level or pattern of expression of a normal transcript).

Assays for variant gene expression can involve direct assays of nucleic acid levels (e.g., mRNA levels), expressed protein levels, or of collateral compounds involved in a signal pathway. Further, the expression of genes that are up- or down-regulated in response to the signal pathway can also be assayed. In this embodiment, the regulatory regions of these genes can be operably linked to a reporter gene such as luciferase.

Modulators of variant gene expression can be identified in a method wherein, for example, a cell is contacted with a candidate compound/agent and the expression of mRNA determined. The level of expression of mRNA in the presence of the candidate compound is compared to the level of expression of mRNA in the absence of the candidate compound. The candidate compound can then be identified as a modulator of variant gene expression based on this comparison and be used to treat a disorder such as CVD that is characterized by variant gene expression (e.g., either expression of a SNP-containing nucleic acid or altered expression of a normal/wild-type nucleic acid molecule due to one or more SNPs that affect expression of the nucleic acid molecule) due to one or more SNPs of the present invention. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP or associated nucleic acid domain (e.g., catalytic domain, ligand/substrate-binding domain, regulatory/control region, etc.) or gene, or the encoded mRNA transcript, as a target, using a compound identified through drug screening as a gene modulator to modulate variant nucleic acid expression. Modulation can include either up-regulation (i.e., activation or agonization) or down-regulation (i.e., suppression or antagonization) of nucleic acid expression.

Expression of mRNA transcripts and encoded proteins, either wild type or variant, may be altered in individuals with a particular SNP allele in a regulatory/control element, such as a promoter or transcription factor binding domain, that regulates expression. In this situation, methods of treatment and compounds can be identified, as discussed herein, that regulate or overcome the variant regulatory/control element, thereby generating normal, or healthy, expression levels of either the wild type or variant protein.

Pharmaceutical Compositions and Administration Thereof

Any of the CVD-associated proteins, and encoding nucleic acid molecules, disclosed herein can be used as therapeutic targets (or directly used themselves as therapeutic compounds) for treating or preventing CVD or related pathologies, and the present disclosure enables therapeutic compounds (e.g., small molecules, antibodies, therapeutic proteins, RNAi and antisense molecules, etc.) to be developed that target (or are comprised of) any of these therapeutic targets.

In general, a therapeutic compound will be administered in a therapeutically effective amount by any of the accepted modes of administration for agents that serve similar utilities.

The actual amount of the therapeutic compound of this invention, i.e., the active ingredient, will depend upon numerous factors such as the severity of the disease to be treated, the age and relative health of the subject, the potency of the compound used, the route and form of administration, and other factors.

Therapeutically effective amounts of therapeutic compounds may range from, for example, approximately 0.01-50 mg per kilogram body weight of the recipient per day; preferably about 0.1-20 mg/kg/day. Thus, as an example, for administration to a 70-kg person, the dosage range would most preferably be about 7 mg to 1.4 g per day.

In general, therapeutic compounds will be administered as pharmaceutical compositions by any one of the following routes: oral, systemic (e.g., transdermal, intranasal, or by suppository), or parenteral (e.g., intramuscular, intravenous, or subcutaneous) administration. The preferred manner of administration is oral or parenteral using a convenient daily dosage regimen, which can be adjusted according to the degree of affliction. Oral compositions can take the form of tablets, pills, capsules, semisolids, powders, sustained release formulations, solutions, suspensions, elixirs, aerosols, or any other appropriate compositions.

The choice of formulation depends on various factors such as the mode of drug administration (e.g., for oral administration, formulations in the form of tablets, pills, or capsules are preferred) and the bioavailability of the drug substance. Recently, pharmaceutical formulations have been developed especially for drugs that show poor bioavailability based upon the principle that bioavailability can be increased by increasing the surface area, i.e., decreasing particle size. For example, U.S. Pat. No. 4,107,288 describes a pharmaceutical formulation having particles in the size range from 10 to 1,000 nm in which the active material is supported on a cross-linked matrix of macromolecules. U.S. Pat. No. 5,145,684 describes the production of a pharmaceutical formulation in which the drug substance is pulverized to nanoparticles (average particle size of 400 nm) in the presence of a surface modifier and then dispersed in a liquid medium to give a pharmaceutical formulation that exhibits remarkably high bioavailability.

Pharmaceutical compositions are comprised of, in general, a therapeutic compound in combination with at least one pharmaceutically acceptable excipient. Acceptable excipients are non-toxic, aid administration, and do not adversely affect the therapeutic benefit of the therapeutic compound. Such excipients may be any solid, liquid, semi-solid or, in the case of an aerosol composition, gaseous excipient that is generally available to one skilled in the art.

Solid pharmaceutical excipients include starch, cellulose, talc, glucose, lactose, sucrose, gelatin, malt, rice, flour, chalk, silica gel, magnesium stearate, sodium stearate, glycerol monostearate, sodium chloride, dried skim milk and the like. Liquid and semisolid excipients may be selected from glycerol, propylene glycol, water, ethanol and various oils, including those of petroleum, animal, vegetable or synthetic origin, e.g., peanut oil, soybean oil, mineral oil, sesame oil, etc. Preferred liquid carriers, particularly for injectable solutions, include water, saline, aqueous dextrose, and glycols.

Compressed gases may be used to disperse a compound of this invention in aerosol form. Inert gases suitable for this purpose are nitrogen, carbon dioxide, etc.

Other suitable pharmaceutical excipients and their formulations are described in *Remington's Pharmaceutical Sciences* 18$^{th}$ ed., E. W. Martin, ed., Mack Publishing Company (1990).

The amount of the therapeutic compound in a formulation can vary within the full range employed by those skilled in the art. Typically, the formulation will contain, on a weight percent (wt %) basis, from about 0.01-99.99 wt % of the therapeutic compound based on the total formulation, with the balance being one or more suitable pharmaceutical excipients. Preferably, the compound is present at a level of about 1-80% wt.

Therapeutic compounds can be administered alone or in combination with other therapeutic compounds or in combination with one or more other active ingredient(s). For example, an inhibitor or stimulator of a CVD-associated protein can be administered in combination with another agent that inhibits or stimulates the activity of the same or a different CVD-associated protein to thereby counteract the effects of CVD.

For further information regarding pharmacology, see *Current Protocols in Pharmacology*, John Wiley & Sons, Inc., N.Y.

Nucleic Acid-Based Therapeutic Agents

The SNP-containing nucleic acid molecules disclosed herein, and their complementary nucleic acid molecules, may be used as antisense constructs to control gene expression in cells, tissues, and organisms. Antisense technology is well established in the art and extensively reviewed in *Antisense Drug Technology: Principles, Strategies, and Applications*, Crooke, ed., Marcel Dekker, Inc., N.Y. (2001). An antisense nucleic acid molecule is generally designed to be complementary to a region of mRNA expressed by a gene so that the antisense molecule hybridizes to the mRNA and thereby blocks translation of mRNA into protein. Various classes of antisense oligonucleotides are used in the art, two of which are cleavers and blockers. Cleavers, by binding to target RNAs, activate intracellular nucleases (e.g., RNaseH or RNase L) that cleave the target RNA. Blockers, which also bind to target RNAs, inhibit protein translation through steric hindrance of ribosomes. Exemplary blockers include peptide nucleic acids, morpholinos, locked nucleic acids, and methylphosphonates. See, e.g., Thompson, *Drug Discovery Today* 7 (17): 912-917 (2002). Antisense oligonucleotides are directly useful as therapeutic agents, and are also useful for determining and validating gene function (e.g., in gene knock-out or knock-down experiments).

Antisense technology is further reviewed in: Layery et al., "Antisense and RNAi: powerful tools in drug target discovery and validation," *Curr Opin Drug Discov Devel* 6 (4):561-9 (July 2003); Stephens et al., "Antisense oligonucleotide therapy in cancer," *Curr Opin Mol Ther* 5 (2):118-22 (April 2003); Kurreck, "Antisense technologies. Improvement through novel chemical modifications," *Eur J Biochem* 270 (8):1628-44 (April 2003); Dias et al., "Antisense oligonucleotides: basic concepts and mechanisms," *Mol Cancer Ther* 1 (5):347-55 (March 2002); Chen, "Clinical development of antisense oligonucleotides as anti-cancer therapeutics," *Methods Mol Med* 75:621-36 (2003); Wang et al., "Antisense anticancer oligonucleotide therapeutics," *Curr Cancer Drug Targets* 1 (3):177-96 (November 2001); and Bennett, "Efficiency of antisense oligonucleotide drug discovery," *Antisense Nucleic Acid Drug Dev* 12 (3):215-24 (June 2002).

The SNPs of the present invention are particularly useful for designing antisense reagents that are specific for particular nucleic acid variants. Based on the SNP information disclosed herein, antisense oligonucleotides can be produced that specifically target mRNA molecules that contain one or more particular SNP nucleotides. In this manner, expression of mRNA molecules that contain one or more undesired polymorphisms (e.g., SNP nucleotides that lead to a defective protein such as an amino acid substitution in a catalytic domain) can be inhibited or completely blocked. Thus, antisense oligonucleotides can be used to specifically bind a particular polymorphic form (e.g., a SNP allele that encodes a defective protein), thereby inhibiting translation of this form, but which do not bind an alternative polymorphic form (e.g., an alternative SNP nucleotide that encodes a protein having normal function).

Antisense molecules can be used to inactivate mRNA in order to inhibit gene expression and production of defective proteins. Accordingly, these molecules can be used to treat a disorder, such as CVD, characterized by abnormal or undesired gene expression or expression of certain defective proteins. This technique can involve cleavage by means of ribozymes containing nucleotide sequences complementary to one or more regions in the mRNA that attenuate the ability of the mRNA to be translated. Possible mRNA regions include, for example, protein-coding regions and particularly protein-coding regions corresponding to catalytic activities, substrate/ligand binding, or other functional activities of a protein.

The SNPs of the present invention are also useful for designing RNA interference reagents that specifically target nucleic acid molecules having particular SNP variants. RNA interference (RNAi), also referred to as gene silencing, is based on using double-stranded RNA (dsRNA) molecules to turn genes off. When introduced into a cell, dsRNAs are processed by the cell into short fragments (generally about 21, 22, or 23 nucleotides in length) known as small interfering RNAs (siRNAs) which the cell uses in a sequence-specific manner to recognize and destroy complementary RNAs. Thompson, *Drug Discovery Today* 7 (17): 912-917 (2002). Accordingly, an aspect of the present invention specifically contemplates isolated nucleic acid molecules that are about 18-26 nucleotides in length, preferably 19-25 nucleotides in length, and more preferably 20, 21, 22, or 23 nucleotides in length, and the use of these nucleic acid molecules for RNAi. Because RNAi molecules, including siRNAs, act in a sequence-specific manner, the SNPs of the present invention can be used to design RNAi reagents that recognize and destroy nucleic acid molecules having specific SNP alleles/nucleotides (such as deleterious alleles that lead to the production of defective proteins), while not affecting nucleic acid molecules having alternative SNP alleles (such as alleles that encode proteins having normal function). As with antisense reagents, RNAi reagents may be directly useful as therapeutic agents (e.g., for turning off defective, disease-causing genes), and are also useful for characterizing and validating gene function (e.g., in gene knock-out or knock-down experiments).

The following references provide a further review of RNAi: Reynolds et al., "Rational siRNA design for RNA interference," *Nat Biotechnol* 22 (3):326-30 (March 2004); Epub Feb. 1, 2004; Chi et al., "Genomewide view of gene silencing by small interfering RNAs," *PNAS* 100 (11):6343-6346 (2003); Vickers et al., "Efficient Reduction of Target RNAs by Small Interfering RNA and RNase H-dependent Antisense Agents," *J Biol Chem* 278:7108-7118 (2003); Agami, "RNAi and related mechanisms and their potential use for therapy," *Curr Opin Chem Biol* 6 (6):829-34 (December 2002); Layery et al., "Antisense and RNAi: powerful tools in drug target discovery and validation," *Curr Opin Drug Discov Devel* 6 (4):561-9 (July 2003); Shi, "Mammalian RNAi for the masses," *Trends Genet* 19 (1):9-12 (January 2003); Shuey et al., "RNAi: gene-silencing in therapeutic intervention," *Drug Discovery Today* 7 (20):1040-1046 (October 2002); McManus et al., *Nat Rev Genet* 3 (10):737-47 (October 2002); Xia et al., *Nat Biotechnol* 20 (10):1006-10 (October 2002); Plasterk et al., *Curr Opin Genet Dev* 10

(5):562-7 (October 2000); Bosher et al., *Nat Cell Biol* 2 (2):E31-6 (February 2000); and Hunter, *Curr Biol* 17; 9 (12): R440-2 (June 1999).

Other Therapeutic Aspects

SNPs have many important uses in drug discovery, screening, and development, and thus the SNPs of the present invention are useful for improving many different aspects of the drug development process.

For example, a high probability exists that, for any gene/protein selected as a potential drug target, variants of that gene/protein will exist in a patient population. Thus, determining the impact of gene/protein variants on the selection and delivery of a therapeutic agent should be an integral aspect of the drug discovery and development process. Jazwinska, *A Trends Guide to Genetic Variation and Genomic Medicine* S30-S36 (March 2002).

Knowledge of variants (e.g., SNPs and any corresponding amino acid polymorphisms) of a particular therapeutic target (e.g., a gene, mRNA transcript, or protein) enables parallel screening of the variants in order to identify therapeutic candidates (e.g., small molecule compounds, antibodies, antisense or RNAi nucleic acid compounds, etc.) that demonstrate efficacy across variants. Rothberg, *Nat Biotechnol* 19 (3):209-11 (March 2001). Such therapeutic candidates would be expected to show equal efficacy across a larger segment of the patient population, thereby leading to a larger potential market for the therapeutic candidate.

Furthermore, identifying variants of a potential therapeutic target enables the most common form of the target to be used for selection of therapeutic candidates, thereby helping to ensure that the experimental activity that is observed for the selected candidates reflects the real activity expected in the largest proportion of a patient population. Jazwinska, *A Trends Guide to Genetic Variation and Genomic Medicine* S30-S36 (March 2002).

Additionally, screening therapeutic candidates against all known variants of a target can enable the early identification of potential toxicities and adverse reactions relating to particular variants. For example, variability in drug absorption, distribution, metabolism and excretion (ADME) caused by, for example, SNPs in therapeutic targets or drug metabolizing genes, can be identified, and this information can be utilized during the drug development process to minimize variability in drug disposition and develop therapeutic agents that are safer across a wider range of a patient population. The SNPs of the present invention, including the variant proteins and encoding polymorphic nucleic acid molecules provided in Tables 1 and 2, are useful in conjunction with a variety of toxicology methods established in the art, such as those set forth in *Current Protocols in Toxicology*, John Wiley & Sons, Inc., N.Y.

Furthermore, therapeutic agents that target any art-known proteins (or nucleic acid molecules, either RNA or DNA) may cross-react with the variant proteins (or polymorphic nucleic acid molecules) disclosed in Table 1, thereby significantly affecting the pharmacokinetic properties of the drug. Consequently, the protein variants and the SNP-containing nucleic acid molecules disclosed in Tables 1 and 2 are useful in developing, screening, and evaluating therapeutic agents that target corresponding art-known protein forms (or nucleic acid molecules). Additionally, as discussed above, knowledge of all polymorphic forms of a particular drug target enables the design of therapeutic agents that are effective against most or all such polymorphic forms of the drug target.

A subject suffering from a pathological condition ascribed to a SNP, such as CVD, may be treated so as to correct the genetic defect. See Kren et al., *Proc Natl Acad Sci USA* 96:10349-10354 (1999). Such a subject can be identified by any method that can detect the polymorphism in a biological sample drawn from the subject. Such a genetic defect may be permanently corrected by administering to such a subject a nucleic acid fragment incorporating a repair sequence that supplies the normal/wild-type nucleotide at the position of the SNP. This site-specific repair sequence can encompass an RNA/DNA oligonucleotide that operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induce incorporation of the normal sequence into the subject's genome. Upon incorporation, the normal gene product is expressed, and the replacement is propagated, thereby engendering a permanent repair and therapeutic enhancement of the clinical condition of the subject.

In cases in which a cSNP results in a variant protein that is ascribed to be the cause of, or a contributing factor to, a pathological condition, a method of treating such a condition can include administering to a subject experiencing the pathology the wild-type/normal cognate of the variant protein. Once administered in an effective dosing regimen, the wild-type cognate provides complementation or remediation of the pathological condition.

Human Identification Applications

In addition to their diagnostic, therapeutic, and preventive uses in CVD and related pathologies, the SNPs provided by the present invention are also useful as human identification markers for such applications as forensics, paternity testing, and biometrics. See, e.g., Gill, "An assessment of the utility of single nucleotide polymorphisms (SNPs) for forensic purposes," *Int J Legal Med* 114 (4-5):204-10 (2001). Genetic variations in the nucleic acid sequences between individuals can be used as genetic markers to identify individuals and to associate a biological sample with an individual. Determination of which nucleotides occupy a set of SNP positions in an individual identifies a set of SNP markers that distinguishes the individual. The more SNP positions that are analyzed, the lower the probability that the set of SNPs in one individual is the same as that in an unrelated individual. Preferably, if multiple sites are analyzed, the sites are unlinked (i.e., inherited independently). Thus, preferred sets of SNPs can be selected from among the SNPs disclosed herein, which may include SNPs on different chromosomes, SNPs on different chromosome arms, and/or SNPs that are dispersed over substantial distances along the same chromosome arm.

Furthermore, among the SNPs disclosed herein, preferred SNPs for use in certain forensic/human identification applications include SNPs located at degenerate codon positions (i.e., the third position in certain codons which can be one of two or more alternative nucleotides and still encode the same amino acid), since these SNPs do not affect the encoded protein. SNPs that do not affect the encoded protein are expected to be under less selective pressure and are therefore expected to be more polymorphic in a population, which is typically an advantage for forensic/human identification applications. However, for certain forensics/human identification applications, such as predicting phenotypic characteristics (e.g., inferring ancestry or inferring one or more physical characteristics of an individual) from a DNA sample, it may be desirable to utilize SNPs that affect the encoded protein.

For many of the SNPs disclosed in Tables 1 and 2 (which are identified as "Applera" SNP source), Tables 1 and 2 provide SNP allele frequencies obtained by re-sequencing the DNA of chromosomes from 39 individuals (Tables 1 and 2 also provide allele frequency information for "Celera" source SNPs and, where available, public SNPs from dbEST, HGBASE, and/or HGMD). The allele frequencies provided in Tables 1 and 2 enable these SNPs to be readily used for human identification applications. Although any SNP disclosed in Table 1 and/or Table 2 could be used for human identification, the closer that the frequency of the minor allele at a particular SNP site is to 50%, the greater the ability of that SNP to discriminate between different individuals in a population since it becomes increasingly likely that two randomly selected individuals would have different alleles at that SNP site. Using the SNP allele frequencies provided in Tables 1 and 2, one of ordinary skill in the art could readily select a subset of SNPs for which the frequency of the minor allele is, for example, at least 1%, 2%, 5%, 10%, 20%, 25%, 30%, 40%, 45%, or 50%, or any other frequency in-between. Thus, since Tables 1 and 2 provide allele frequencies based on the re-sequencing of the chromosomes from 39 individuals, a subset of SNPs could readily be selected for human identification in which the total allele count of the minor allele at a particular SNP site is, for example, at least 1, 2, 4, 8, 10, 16, 20, 24, 30, 32, 36, 38, 39, 40, or any other number in-between.

Furthermore, Tables 1 and 2 also provide population group (interchangeably referred to herein as ethnic or racial groups) information coupled with the extensive allele frequency information. For example, the group of 39 individuals whose DNA was re-sequenced was made-up of 20 Caucasians and 19 African-Americans. This population group information enables further refinement of SNP selection for human identification. For example, preferred SNPs for human identification can be selected from Tables 1 and 2 that have similar allele frequencies in both the Caucasian and African-American populations; thus, for example, SNPs can be selected that have equally high discriminatory power in both populations. Alternatively, SNPs can be selected for which there is a statistically significant difference in allele frequencies between the Caucasian and African-American populations (as an extreme example, a particular allele may be observed only in either the Caucasian or the African-American population group but not observed in the other population group); such SNPs are useful, for example, for predicting the race/ethnicity of an unknown perpetrator from a biological sample such as a hair or blood stain recovered at a crime scene. For a discussion of using SNPs to predict ancestry from a DNA sample, including statistical methods, see Frudakis et al., "A Classifier for the SNP-Based Inference of Ancestry," *Journal of Forensic Sciences* 48 (4):771-782 (2003).

SNPs have numerous advantages over other types of polymorphic markers, such as short tandem repeats (STRs). For example, SNPs can be easily scored and are amenable to automation, making SNPs the markers of choice for large-scale forensic databases. SNPs are found in much greater abundance throughout the genome than repeat polymorphisms. Population frequencies of two polymorphic forms can usually be determined with greater accuracy than those of multiple polymorphic forms at multi-allelic loci. SNPs are mutationally more stable than repeat polymorphisms. SNPs are not susceptible to artifacts such as stutter bands that can hinder analysis. Stutter bands are frequently encountered when analyzing repeat polymorphisms, and are particularly troublesome when analyzing samples such as crime scene samples that may contain mixtures of DNA from multiple sources. Another significant advantage of SNP markers over STR markers is the much shorter length of nucleic acid needed to score a SNP. For example, STR markers are generally several hundred base pairs in length. A SNP, on the other hand, comprises a single nucleotide, and generally a short conserved region on either side of the SNP position for primer and/or probe binding. This makes SNPs more amenable to typing in highly degraded or aged biological samples that are frequently encountered in forensic casework in which DNA may be fragmented into short pieces.

SNPs also are not subject to microvariant and "off-ladder" alleles frequently encountered when analyzing STR loci. Microvariants are deletions or insertions within a repeat unit that change the size of the amplified DNA product so that the amplified product does not migrate at the same rate as reference alleles with normal sized repeat units. When separated by size, such as by electrophoresis on a polyacrylamide gel, microvariants do not align with a reference allelic ladder of standard sized repeat units, but rather migrate between the reference alleles. The reference allelic ladder is used for precise sizing of alleles for allele classification; therefore alleles that do not align with the reference allelic ladder lead to substantial analysis problems. Furthermore, when analyzing multi-allelic repeat polymorphisms, occasionally an allele is found that consists of more or less repeat units than has been previously seen in the population, or more or less repeat alleles than are included in a reference allelic ladder. These alleles will migrate outside the size range of known alleles in a reference allelic ladder, and therefore are referred to as "off-ladder" alleles. In extreme cases, the allele may contain so few or so many repeats that it migrates well out of the range of the reference allelic ladder. In this situation, the allele may not even be observed, or, with multiplex analysis, it may migrate within or close to the size range for another locus, further confounding analysis.

SNP analysis avoids the problems of microvariants and off-ladder alleles encountered in STR analysis. Importantly, microvariants and off-ladder alleles may provide significant problems, and may be completely missed, when using analysis methods such as oligonucleotide hybridization arrays, which utilize oligonucleotide probes specific for certain known alleles. Furthermore, off-ladder alleles and microvariants encountered with STR analysis, even when correctly typed, may lead to improper statistical analysis, since their frequencies in the population are generally unknown or poorly characterized, and therefore the statistical significance of a matching genotype may be questionable. All these advantages of SNP analysis are considerable in light of the consequences of most DNA identification cases, which may lead to life imprisonment for an individual, or re-association of remains to the family of a deceased individual.

DNA can be isolated from biological samples such as blood, bone, hair, saliva, or semen, and compared with the DNA from a reference source at particular SNP positions. Multiple SNP markers can be assayed simultaneously in order to increase the power of discrimination and the statistical significance of a matching genotype. For example, oligonucleotide arrays can be used to genotype a large number of SNPs simultaneously. The SNPs provided by the present invention can be assayed in combination with other polymorphic genetic markers, such as other SNPs known in the art or STRs, in order to identify an individual or to associate an individual with a particular biological sample.

Furthermore, the SNPs provided by the present invention can be genotyped for inclusion in a database of DNA genotypes, for example, a criminal DNA databank such as the FBI's Combined DNA Index System (CODIS) database. A genotype obtained from a biological sample of unknown source can then be queried against the database to find a matching genotype, with the SNPs of the present invention providing nucleotide positions at which to compare the known and unknown DNA sequences for identity. Accordingly, the present invention provides a database comprising novel SNPs or SNP alleles of the present invention (e.g., the database can comprise information indicating which alleles are possessed by individual members of a population at one or more novel SNP sites of the present invention), such as for use in forensics, biometrics, or other human identification applications. Such a database typically comprises a computer-based system in which the SNPs or SNP alleles of the present invention are recorded on a computer readable medium.

The SNPs of the present invention can also be assayed for use in paternity testing. The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child, with the SNPs of the present invention providing nucleotide positions at which to compare the putative father's and child's DNA sequences for identity. If the set of polymorphisms in the child attributable to the father does not match the set of polymorphisms of the putative father, it can be concluded, barring experimental error, that the putative father is not the father of the child. If the set of polymorphisms in the child attributable to the father match the set of polymorphisms of the putative father, a statistical calculation can be performed to determine the probability of coincidental match, and a conclusion drawn as to the likelihood that the putative father is the true biological father of the child.

In addition to paternity testing, SNPs are also useful for other types of kinship testing, such as for verifying familial relationships for immigration purposes, or for cases in which an individual alleges to be related to a deceased individual in order to claim an inheritance from the deceased individual, etc. For further information regarding the utility of SNPs for paternity testing and other types of kinship testing, including methods for statistical analysis, see Krawczak, "Informativity assessment for biallelic single nucleotide polymorphisms," *Electrophoresis* 20 (8):1676-81 (June 1999).

The use of the SNPs of the present invention for human identification further extends to various authentication systems, commonly referred to as biometric systems, which typically convert physical characteristics of humans (or other organisms) into digital data. Biometric systems include various technological devices that measure such unique anatomical or physiological characteristics as finger, thumb, or palm prints; hand geometry; vein patterning on the back of the hand; blood vessel patterning of the retina and color and texture of the iris; facial characteristics; voice patterns; signature and typing dynamics; and DNA. Such physiological measurements can be used to verify identity and, for example, restrict or allow access based on the identification. Examples of applications for biometrics include physical area security, computer and network security, aircraft passenger check-in and boarding, financial transactions, medical records access, government benefit distribution, voting, law enforcement, passports, visas and immigration, prisons, various military applications, and for restricting access to expensive or dangerous items, such as automobiles or guns. See, for example, O'Connor, *Stanford Technology Law Review*, and U.S. Pat. No. 6,119,096.

Groups of SNPs, particularly the SNPs provided by the present invention, can be typed to uniquely identify an individual for biometric applications such as those described above. Such SNP typing can readily be accomplished using, for example, DNA chips/arrays. Preferably, a minimally invasive means for obtaining a DNA sample is utilized. For example, PCR amplification enables sufficient quantities of DNA for analysis to be obtained from buccal swabs or fingerprints, which contain DNA-containing skin cells and oils that are naturally transferred during contact.

Further information regarding techniques for using SNPs in forensic/human identification applications can be found, for example, in *Current Protocols in Human Genetics* 14.1-14.7, John Wiley & Sons, N.Y. (2002).

Variant Proteins, Antibodies, Vectors, Host Cells, & Uses Thereof

Variant Proteins Encoded by SNP-Containing Nucleic Acid Molecules

The present invention provides SNP-containing nucleic acid molecules, many of which encode proteins having variant amino acid sequences as compared to the art-known (i.e., wild-type) proteins. Amino acid sequences encoded by the polymorphic nucleic acid molecules of the present invention are referred to as SEQ ID NOS:308-614 in Table 1 and provided in the Sequence Listing. These variants will generally be referred to herein as variant proteins/peptides/polypeptides, or polymorphic proteins/peptides/polypeptides of the present invention. The terms "protein," "peptide," and "polypeptide" are used herein interchangeably.

A variant protein of the present invention may be encoded by, for example, a nonsynonymous nucleotide substitution at any one of the cSNP positions disclosed herein. In addition, variant proteins may also include proteins whose expression, structure, and/or function is altered by a SNP disclosed herein, such as a SNP that creates or destroys a stop codon, a SNP that affects splicing, and a SNP in control/regulatory elements, e.g. promoters, enhancers, or transcription factor binding domains.

As used herein, a protein or peptide is said to be "isolated" or "purified" when it is substantially free of cellular material or chemical precursors or other chemicals. The variant proteins of the present invention can be purified to homogeneity or other lower degrees of purity. The level of purification will be based on the intended use. The key feature is that the preparation allows for the desired function of the variant protein, even if in the presence of considerable amounts of other components.

As used herein, "substantially free of cellular material" includes preparations of the variant protein having less than about 30% (by dry weight) other proteins (i.e., contaminating protein), less than about 20% other proteins, less than about 10% other proteins, or less than about 5% other proteins. When the variant protein is recombinantly produced, it can also be substantially free of culture medium, i.e., culture medium represents less than about 20% of the volume of the protein preparation.

The language "substantially free of chemical precursors or other chemicals" includes preparations of the variant protein in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

An isolated variant protein may be purified from cells that naturally express it, purified from cells that have been altered to express it (recombinant host cells), or synthesized using known protein synthesis methods. For example, a nucleic acid molecule containing SNP(s) encoding the variant protein can be cloned into an expression vector, the expression vector introduced into a host cell, and the variant protein expressed in the host cell. The variant protein can then be isolated from the cells by any appropriate purification scheme using standard protein purification techniques. Examples of these techniques are described in detail below. Sambrook and Russell, *Molecular Cloning: A Laboratory Manual*, Cold Spring Harbor Laboratory Press, N.Y. (2000).

The present invention provides isolated variant proteins that comprise, consist of or consist essentially of amino acid sequences that contain one or more variant amino acids encoded by one or more codons that contain a SNP of the present invention.

Accordingly, the present invention provides variant proteins that consist of amino acid sequences that contain one or more amino acid polymorphisms (or truncations or extensions due to creation or destruction of a stop codon, respectively) encoded by the SNPs provided in Table 1 and/or Table 2. A protein consists of an amino acid sequence when the amino acid sequence is the entire amino acid sequence of the protein.

The present invention further provides variant proteins that consist essentially of amino acid sequences that contain one or more amino acid polymorphisms (or truncations or extensions due to creation or destruction of a stop codon, respectively) encoded by the SNPs provided in Table 1 and/or Table 2. A protein consists essentially of an amino acid sequence when such an amino acid sequence is present with only a few additional amino acid residues in the final protein.

The present invention further provides variant proteins that comprise amino acid sequences that contain one or more amino acid polymorphisms (or truncations or extensions due to creation or destruction of a stop codon, respectively) encoded by the SNPs provided in Table 1 and/or Table 2. A protein comprises an amino acid sequence when the amino acid sequence is at least part of the final amino acid sequence of the protein. In such a fashion, the protein may contain only the variant amino acid sequence or have additional amino acid residues, such as a contiguous encoded sequence that is naturally associated with it or heterologous amino acid residues. Such a protein can have a few additional amino acid residues or can comprise many more additional amino acids. A brief description of how various types of these proteins can be made and isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the coding sequences for the variant protein and the heterologous protein are ligated in-frame. The heterologous protein can be fused to the N-terminus or C-terminus of the variant protein. In another embodiment, the fusion protein is encoded by a fusion polynucleotide that is synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence. See Ausubel et al., *Current Protocols in Molecular Biology* (1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

In many uses, the fusion protein does not affect the activity of the variant protein. The fusion protein can include, but is not limited to, enzymatic fusion proteins, for example, beta-galactosidase fusions, yeast two-hybrid GAL fusions, poly-His fusions, MYC-tagged, HI-tagged and Ig fusions. Such fusion proteins, particularly poly-His fusions, can facilitate their purification following recombinant expression. In certain host cells (e.g., mammalian host cells), expression and/or secretion of a protein can be increased by using a heterologous signal sequence. Fusion proteins are further described in, for example, Terpe, "Overview of tag protein fusions: from molecular and biochemical fundamentals to commercial systems," *Appl Microbiol Biotechnol* 60 (5):523-33 (January 2003); Epub Nov. 7, 2002; Graddis et al., "Designing proteins that work using recombinant technologies," *Curr Pharm Biotechnol* 3 (4):285-97 (December 2002); and Nilsson et al., "Affinity fusion strategies for detection, purification, and immobilization of recombinant proteins," *Protein Expr Purif* 11 (1): 1-16 (October 1997).

In certain embodiments, novel compositions of the present invention also relate to further obvious variants of the variant polypeptides of the present invention, such as naturally-occurring mature forms (e.g., allelic variants), non-naturally occurring recombinantly-derived variants, and orthologs and paralogs of such proteins that share sequence homology. Such variants can readily be generated using art-known techniques in the fields of recombinant nucleic acid technology and protein biochemistry.

Further variants of the variant polypeptides disclosed in Table 1 can comprise an amino acid sequence that shares at least 70-80%, 80-85%, 85-90%, 91%, 92%, 93%, 94%, 95%, 96%, 97%, 98%, or 99% sequence identity with an amino acid sequence disclosed in Table 1 (or a fragment thereof) and that includes a novel amino acid residue (allele) disclosed in Table 1 (which is encoded by a novel SNP allele). Thus, an aspect of the present invention that is specifically contemplated are polypeptides that have a certain degree of sequence variation compared with the polypeptide sequences shown in Table 1, but that contain a novel amino acid residue (allele) encoded by a novel SNP allele disclosed herein. In other words, as long as a polypeptide contains a novel amino acid residue disclosed herein, other portions of the polypeptide that flank the novel amino acid residue can vary to some degree from the polypeptide sequences shown in Table 1.

Full-length pre-processed forms, as well as mature processed forms, of proteins that comprise one of the amino acid sequences disclosed herein can readily be identified as having complete sequence identity to one of the variant proteins of the present invention as well as being encoded by the same genetic locus as the variant proteins provided herein.

Orthologs of a variant peptide can readily be identified as having some degree of significant sequence homology/identity to at least a portion of a variant peptide as well as being encoded by a gene from another organism. Preferred orthologs will be isolated from non-human mammals, preferably primates, for the development of human therapeutic targets and agents. Such orthologs can be encoded by a nucleic acid sequence that hybridizes to a variant peptide-encoding nucleic acid molecule under moderate to stringent conditions depending on the degree of relatedness of the two organisms yielding the homologous proteins.

Variant proteins include, but are not limited to, proteins containing deletions, additions and substitutions in the amino acid sequence caused by the SNPs of the present invention. One class of substitutions is conserved amino acid substitutions in which a given amino acid in a polypeptide is substituted for another amino acid of like characteristics. Typical conservative substitutions are replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found, for example, in Bowie et al., *Science* 247:1306-1310 (1990).

Variant proteins can be fully functional or can lack function in one or more activities, e.g. ability to bind another molecule, ability to catalyze a substrate, ability to mediate signaling, etc. Fully functional variants typically contain only conservative variations or variations in non-critical residues or in non-critical regions. Functional variants can also contain substitution of similar amino acids that result in no change or an insignificant change in function. Alternatively, such substitutions may positively or negatively affect function to some degree. Non-functional variants typically contain one or more non-conservative amino acid substitutions, deletions, insertions, inversions, truncations or extensions, or a substitution, insertion, inversion, or deletion of a critical residue or in a critical region.

Amino acids that are essential for function of a protein can be identified by methods known in the art, such as site-directed mutagenesis or alanine-scanning mutagenesis, particularly using the amino acid sequence and polymorphism information provided in Table 1. Cunningham et al., *Science* 244:1081-1085 (1989). The latter procedure introduces single alanine mutations at every residue in the molecule. The resulting mutant molecules are then tested for biological activity such as enzyme activity or in assays such as an in vitro proliferative activity. Sites that are critical for binding partner/substrate binding can also be determined by structural analysis such as crystallization, nuclear magnetic resonance or photoaffinity labeling. Smith et al., *J Mol Biol* 224:899-904 (1992); de Vos et al., *Science* 255:306-312 (1992).

Polypeptides can contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Accordingly, the variant proteins of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (e.g., polyethylene glycol), or in which additional amino acids are fused to the mature polypeptide, such as a leader or secretory sequence or a sequence for purification of the mature polypeptide or a pro-protein sequence.

Known protein modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such protein modifications are well known to those of skill in the art and have been described in great detail in the scientific literature. Particularly common modifications, for example glycosylation, lipid attachment, sulfation, gamma-carboxylation of glutamic acid residues, hydroxylation and ADP-ribosylation, are described in most basic texts, such as *Proteins—Structure and Molecular Properties* 2nd Ed., T. E. Creighton, W.H. Freeman and Company, N.Y. (1993); F. Wold, *Posttranslational Covalent Modification of Proteins* 1-12, B. C. Johnson, ed., Academic Press, N.Y. (1983); Seifter et al., *Meth Enzymol* 182:626-646 (1990); and Rattan et al., *Ann NY Acad Sci* 663:48-62 (1992).

The present invention further provides fragments of the variant proteins in which the fragments contain one or more amino acid sequence variations (e.g., substitutions, or truncations or extensions due to creation or destruction of a stop codon) encoded by one or more SNPs disclosed herein. The fragments to which the invention pertains, however, are not to be construed as encompassing fragments that have been disclosed in the prior art before the present invention.

As used herein, a fragment may comprise at least about 4, 8, 10, 12, 14, 16, 18, 20, 25, 30, 50, 100 (or any other number in-between) or more contiguous amino acid residues from a variant protein, wherein at least one amino acid residue is affected by a SNP of the present invention, e.g., a variant amino acid residue encoded by a nonsynonymous nucleotide substitution at a cSNP position provided by the present invention. The variant amino acid encoded by a cSNP may occupy any residue position along the sequence of the fragment. Such fragments can be chosen based on the ability to retain one or more of the biological activities of the variant protein or the ability to perform a function, e.g., act as an immunogen. Particularly important fragments are biologically active fragments. Such fragments will typically comprise a domain or motif of a variant protein of the present invention, e.g., active site, transmembrane domain, or ligand/substrate binding domain. Other fragments include, but are not limited to, domain or motif-containing fragments, soluble peptide fragments, and fragments containing immunogenic structures. Predicted domains and functional sites are readily identifiable by computer programs well known to those of skill in the art (e.g., PROSITE analysis). *Current Protocols in Protein Science*, John Wiley & Sons, N.Y. (2002).

Uses of Variant Proteins

The variant proteins of the present invention can be used in a variety of ways, including but not limited to, in assays to determine the biological activity of a variant protein, such as in a panel of multiple proteins for high-throughput screening; to raise antibodies or to elicit another type of immune response; as a reagent (including the labeled reagent) in assays designed to quantitatively determine levels of the variant protein (or its binding partner) in biological fluids; as a marker for cells or tissues in which it is preferentially expressed (either constitutively or at a particular stage of tissue differentiation or development or in a disease state); as a target for screening for a therapeutic agent; and as a direct therapeutic agent to be administered into a human subject. Any of the variant proteins disclosed herein may be developed into reagent grade or kit format for commercialization as research products. Methods for performing the uses listed above are well known to those skilled in the art. See, e.g.,

*Molecular Cloning: A Laboratory Manual*, Sambrook and Russell, Cold Spring Harbor Laboratory Press, N.Y. (2000), and *Methods in Enzymology: Guide to Molecular Cloning Techniques*, S. L. Berger and A. R. Kimmel, eds., Academic Press (1987).

In a specific embodiment of the invention, the methods of the present invention include detection of one or more variant proteins disclosed herein. Variant proteins are disclosed in Table 1 and in the Sequence Listing as SEQ ID NOS:308-614. Detection of such proteins can be accomplished using, for example, antibodies, small molecule compounds, aptamers, ligands/substrates, other proteins or protein fragments, or other protein-binding agents. Preferably, protein detection agents are specific for a variant protein of the present invention and can therefore discriminate between a variant protein of the present invention and the wild-type protein or another variant form. This can generally be accomplished by, for example, selecting or designing detection agents that bind to the region of a protein that differs between the variant and wild-type protein, such as a region of a protein that contains one or more amino acid substitutions that is/are encoded by a non-synonymous cSNP of the present invention, or a region of a protein that follows a nonsense mutation-type SNP that creates a stop codon thereby leading to a shorter polypeptide, or a region of a protein that follows a read-through mutation-type SNP that destroys a stop codon thereby leading to a longer polypeptide in which a portion of the polypeptide is present in one version of the polypeptide but not the other.

In another specific aspect of the invention, the variant proteins of the present invention are used as targets for diagnosing CVD or for determining predisposition to CVD in a human, for treating and/or preventing CVD, or for predicting an individual's response to a treatment (particularly treatment or prevention of CVD), etc. Accordingly, the invention provides methods for detecting the presence of, or levels of, one or more variant proteins of the present invention in a cell, tissue, or organism. Such methods typically involve contacting a test sample with an agent (e.g., an antibody, small molecule compound, or peptide) capable of interacting with the variant protein such that specific binding of the agent to the variant protein can be detected. Such an assay can be provided in a single detection format or a multi-detection format such as an array, for example, an antibody or aptamer array (arrays for protein detection may also be referred to as "protein chips"). The variant protein of interest can be isolated from a test sample and assayed for the presence of a variant amino acid sequence encoded by one or more SNPs disclosed by the present invention. The SNPs may cause changes to the protein and the corresponding protein function/activity, such as through non-synonymous substitutions in protein coding regions that can lead to amino acid substitutions, deletions, insertions, and/or rearrangements; formation or destruction of stop codons; or alteration of control elements such as promoters. SNPs may also cause inappropriate post-translational modifications.

One preferred agent for detecting a variant protein in a sample is an antibody capable of selectively binding to a variant form of the protein (antibodies are described in greater detail in the next section). Such samples include, for example, tissues, cells, and biological fluids isolated from a subject, as well as tissues, cells and fluids present within a subject.

In vitro methods for detection of the variant proteins associated with CVD that are disclosed herein and fragments thereof include, but are not limited to, enzyme linked immunosorbent assays (ELISAs), radioimmunoassays (RIA), Western blots, immunoprecipitations, immunofluorescence, and protein arrays/chips (e.g., arrays of antibodies or aptamers). For further information regarding immunoassays and related protein detection methods, see *Current Protocols in Immunology*, John Wiley & Sons, N.Y., and Hage, "Immunoassays," *Anal Chem* 15; 71 (12):294R-304R (June 1999).

Additional analytic methods of detecting amino acid variants include, but are not limited to, altered electrophoretic mobility, altered tryptic peptide digest, altered protein activity in cell-based or cell-free assay, alteration in ligand or antibody-binding pattern, altered isoelectric point, and direct amino acid sequencing.

Alternatively, variant proteins can be detected in vivo in a subject by introducing into the subject a labeled antibody (or other type of detection reagent) specific for a variant protein. For example, the antibody can be labeled with a radioactive marker whose presence and location in a subject can be detected by standard imaging techniques.

Other uses of the variant peptides of the present invention are based on the class or action of the protein. For example, proteins isolated from humans and their mammalian orthologs serve as targets for identifying agents (e.g., small molecule drugs or antibodies) for use in therapeutic applications, particularly for modulating a biological or pathological response in a cell or tissue that expresses the protein. Pharmaceutical agents can be developed that modulate protein activity.

As an alternative to modulating gene expression, therapeutic compounds can be developed that modulate protein function. For example, many SNPs disclosed herein affect the amino acid sequence of the encoded protein (e.g., non-synonymous cSNPs and nonsense mutation-type SNPs). Such alterations in the encoded amino acid sequence may affect protein function, particularly if such amino acid sequence variations occur in functional protein domains, such as catalytic domains, ATP-binding domains, or ligand/substrate binding domains. It is well established in the art that variant proteins having amino acid sequence variations in functional domains can cause or influence pathological conditions. In such instances, compounds (e.g., small molecule drugs or antibodies) can be developed that target the variant protein and modulate (e.g., up- or down-regulate) protein function/activity.

The therapeutic methods of the present invention further include methods that target one or more variant proteins of the present invention. Variant proteins can be targeted using, for example, small molecule compounds, antibodies, aptamers, ligands/substrates, other proteins, or other protein-binding agents. Additionally, the skilled artisan will recognize that the novel protein variants (and polymorphic nucleic acid molecules) disclosed in Table 1 may themselves be directly used as therapeutic agents by acting as competitive inhibitors of corresponding art-known proteins (or nucleic acid molecules such as mRNA molecules).

The variant proteins of the present invention are particularly useful in drug screening assays, in cell-based or cell-free systems. Cell-based systems can utilize cells that naturally express the protein, a biopsy specimen, or cell cultures. In one embodiment, cell-based assays involve recombinant host cells expressing the variant protein. Cell-free assays can be used to detect the ability of a compound to directly bind to a variant protein or to the corresponding SNP-containing nucleic acid fragment that encodes the variant protein.

A variant protein of the present invention, as well as appropriate fragments thereof, can be used in high-throughput screening assays to test candidate compounds for the ability to bind and/or modulate the activity of the variant protein. These candidate compounds can be further screened against a protein having normal function (e.g., a wild-type/non-variant protein) to further determine the effect of the compound on the protein activity. Furthermore, these compounds can be tested in animal or invertebrate systems to determine in vivo activity/effectiveness. Compounds can be identified that activate (agonists) or inactivate (antagonists) the variant protein, and different compounds can be identified that cause various degrees of activation or inactivation of the variant protein.

Further, the variant proteins can be used to screen a compound for the ability to stimulate or inhibit interaction between the variant protein and a target molecule that normally interacts with the protein. The target can be a ligand, a substrate or a binding partner that the protein normally interacts with (for example, epinephrine or norepinephrine). Such assays typically include the steps of combining the variant protein with a candidate compound under conditions that allow the variant protein, or fragment thereof, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., Nature 354:82-84 (1991); Houghten et al., Nature 354: 84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., Cell 72:767-778 (1993)); 3) antibodies (e.g., polyclonal, monoclonal, humanized, anti-idiotypic, chimeric, and single chain antibodies as well as Fab, F(ab')$_2$, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art.

Binding and/or activating compounds can also be screened by using chimeric variant proteins in which an amino terminal extracellular domain or parts thereof, an entire transmembrane domain or subregions, and/or the carboxyl terminal intracellular domain or parts thereof, can be replaced by heterologous domains or subregions. For example, a substrate-binding region can be used that interacts with a different substrate than that which is normally recognized by a variant protein. Accordingly, a different set of signal transduction components is available as an end-point assay for activation. This allows for assays to be performed in other than the specific host cell from which the variant protein is derived.

The variant proteins are also useful in competition binding assays in methods designed to discover compounds that interact with the variant protein. Thus, a compound can be exposed to a variant protein under conditions that allow the compound to bind or to otherwise interact with the variant protein. A binding partner, such as ligand, that normally interacts with the variant protein is also added to the mixture. If the test compound interacts with the variant protein or its binding partner, it decreases the amount of complex formed or activity from the variant protein. This type of assay is particularly useful in screening for compounds that interact with specific regions of the variant protein. Hodgson, Bio/technology, 10 (9), 973-80 (September 1992).

To perform cell-free drug screening assays, it is sometimes desirable to immobilize either the variant protein or a fragment thereof, or its target molecule, to facilitate separation of complexes from uncomplexed forms of one or both of the proteins, as well as to accommodate automation of the assay. Any method for immobilizing proteins on matrices can be used in drug screening assays. In one embodiment, a fusion protein containing an added domain allows the protein to be bound to a matrix. For example, glutathione-S-transferase/$^{125}$I fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads can be washed to remove any unbound label, and the matrix immobilized and radiolabel determined directly, or in the supernatant after the complexes are dissociated. Alternatively, the complexes can be dissociated from the matrix, separated by SDS-PAGE, and the level of bound material found in the bead fraction quantitated from the gel using standard electrophoretic techniques.

Either the variant protein or its target molecule can be immobilized utilizing conjugation of biotin and streptavidin. Alternatively, antibodies reactive with the variant protein but which do not interfere with binding of the variant protein to its target molecule can be derivatized to the wells of the plate, and the variant protein trapped in the wells by antibody conjugation. Preparations of the target molecule and a candidate compound are incubated in the variant protein-presenting wells and the amount of complex trapped in the well can be quantitated. Methods for detecting such complexes, in addition to those described above for the GST-immobilized complexes, include immunodetection of complexes using antibodies reactive with the protein target molecule, or which are reactive with variant protein and compete with the target molecule, and enzyme-linked assays that rely on detecting an enzymatic activity associated with the target molecule.

Modulators of variant protein activity identified according to these drug screening assays can be used to treat a subject with a disorder mediated by the protein pathway, such as CVD. These methods of treatment typically include the steps of administering the modulators of protein activity in a pharmaceutical composition to a subject in need of such treatment.

The variant proteins, or fragments thereof, disclosed herein can themselves be directly used to treat a disorder characterized by an absence of, inappropriate, or unwanted expression or activity of the variant protein. Accordingly, methods for treatment include the use of a variant protein disclosed herein or fragments thereof.

In yet another aspect of the invention, variant proteins can be used as "bait proteins" in a two-hybrid assay or three-hybrid assay to identify other proteins that bind to or interact with the variant protein and are involved in variant protein activity. See, e.g., U.S. Pat. No. 5,283,317; Zervos et al., *Cell* 72:223-232 (1993); Madura et al., *J Biol Chem* 268:12046-12054 (1993); Bartel et al., *Biotechniques* 14:920-924 (1993); Iwabuchi et al., *Oncogene* 8:1693-1696 (1993); and Brent, WO 94/10300. Such variant protein-binding proteins are also likely to be involved in the propagation of signals by the variant proteins or variant protein targets as, for example, elements of a protein-mediated signaling pathway. Alternatively, such variant protein-binding proteins are inhibitors of the variant protein.

The two-hybrid system is based on the modular nature of most transcription factors, which typically consist of separable DNA-binding and activation domains. Briefly, the assay typically utilizes two different DNA constructs. In one construct, the gene that codes for a variant protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a variant protein-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected, and cell colonies containing the functional transcription factor can be isolated and used to obtain the cloned gene that encodes the protein that interacts with the variant protein.

Antibodies Directed to Variant Proteins

The present invention also provides antibodies that selectively bind to the variant proteins disclosed herein and fragments thereof. Such antibodies may be used to quantitatively or qualitatively detect the variant proteins of the present invention. As used herein, an antibody selectively binds a target variant protein when it binds the variant protein and does not significantly bind to non-variant proteins, i.e., the antibody does not significantly bind to normal, wild-type, or art-known proteins that do not contain a variant amino acid sequence due to one or more SNPs of the present invention (variant amino acid sequences may be due to, for example, nonsynonymous cSNPs, nonsense SNPs that create a stop codon, thereby causing a truncation of a polypeptide or SNPs that cause read-through mutations resulting in an extension of a polypeptide).

As used herein, an antibody is defined in terms consistent with that recognized in the art: they are multi-subunit proteins produced by an organism in response to an antigen challenge. The antibodies of the present invention include both monoclonal antibodies and polyclonal antibodies, as well as antigen-reactive proteolytic fragments of such antibodies, such as Fab, F(ab)'$_2$, and Fv fragments. In addition, an antibody of the present invention further includes any of a variety of engineered antigen-binding molecules such as a chimeric antibody (U.S. Pat. Nos. 4,816,567 and 4,816,397; Morrison et al., *Proc Natl Acad Sci USA* 81:6851 (1984); Neuberger et al., *Nature* 312:604 (1984)), a humanized antibody (U.S. Pat. Nos. 5,693,762; 5,585,089 and 5,565,332), a single-chain Fv (U.S. Pat. No. 4,946,778; Ward et al., *Nature* 334:544 (1989)), a bispecific antibody with two binding specificities (Segal et al., *J Immunol Methods* 248:1 (2001); Carter, *J Immunol Methods* 248:7 (2001)), a diabody, a triabody, and a tetrabody (Todorovska et al., *J Immunol Methods* 248:47 (2001)), as well as a Fab conjugate (dimer or trimer), and a minibody.

Many methods are known in the art for generating and/or identifying antibodies to a given target antigen. Harlow, Antibodies, Cold Spring Harbor Press, N.Y. (1989). In general, an isolated peptide (e.g., a variant protein of the present invention) is used as an immunogen and is administered to a mammalian organism, such as a rat, rabbit, hamster or mouse. Either a full-length protein, an antigenic peptide fragment (e.g., a peptide fragment containing a region that varies between a variant protein and a corresponding wild-type protein), or a fusion protein can be used. A protein used as an immunogen may be naturally-occurring, synthetic or recombinantly produced, and may be administered in combination with an adjuvant, including but not limited to, Freund's (complete and incomplete), mineral gels such as aluminum hydroxide, surface active substance such as lysolecithin, pluronic polyols, polyanions, peptides, oil emulsions, keyhole limpet hemocyanin, dinitrophenol, and the like.

Monoclonal antibodies can be produced by hybridoma technology, which immortalizes cells secreting a specific monoclonal antibody. Kohler and Milstein, *Nature* 256:495 (1975). The immortalized cell lines can be created in vitro by fusing two different cell types, typically lymphocytes, and tumor cells. The hybridoma cells may be cultivated in vitro or in vivo. Additionally, fully human antibodies can be generated by transgenic animals. He et al., *J Immunol* 169:595 (2002). Fd phage and Fd phagemid technologies may be used to generate and select recombinant antibodies in vitro. Hoogenboom and Chames, *Immunol Today* 21:371 (2000); Liu et al., *J Mol Biol* 315:1063 (2002). The complementarity-determining regions of an antibody can be identified, and synthetic peptides corresponding to such regions may be used to mediate antigen binding. U.S. Pat. No. 5,637,677.

Antibodies are preferably prepared against regions or discrete fragments of a variant protein containing a variant amino acid sequence as compared to the corresponding wild-type protein (e.g., a region of a variant protein that includes an amino acid encoded by a nonsynonymous cSNP, a region affected by truncation caused by a nonsense SNP that creates a stop codon, or a region resulting from the destruction of a stop codon due to read-through mutation caused by a SNP). Furthermore, preferred regions will include those involved in function/activity and/or protein/binding partner interaction. Such fragments can be selected on a physical property, such as fragments corresponding to regions that are located on the surface of the protein, e.g., hydrophilic regions, or can be selected based on sequence uniqueness, or based on the position of the variant amino acid residue(s) encoded by the SNPs provided by the present invention. An antigenic fragment will typically comprise at least about 8-10 contiguous amino acid residues in which at least one of the amino acid residues is an amino acid affected by a SNP disclosed herein. The antigenic peptide can comprise, however, at least 12, 14, 16, 20, 25, 50, 100 (or any other number in-between) or more amino acid residues, provided that at least one amino acid is affected by a SNP disclosed herein.

Detection of an antibody of the present invention can be facilitated by coupling (i.e., physically linking) the antibody or an antigen-reactive fragment thereof to a detectable substance. Detectable substances include, but are not limited to, various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$.

Antibodies, particularly the use of antibodies as therapeutic agents, are reviewed in: Morgan, "Antibody therapy for Alzheimer's disease," *Expert Rev Vaccines* (1):53-9 (February 2003); Ross et al., "Anticancer antibodies," *Am J Clin Pathol* 119 (4):472-85 (April 2003); Goldenberg, "Advancing role of radiolabeled antibodies in the therapy of cancer," *Cancer Immunol Immunother* 52 (5):281-96 (May 2003); Epub Mar. 11, 2003; Ross et al., "Antibody-based therapeutics in oncology," *Expert Rev Anticancer Ther* 3 (1):107-21 (February 2003); Cao et al., "Bispecific antibody conjugates in therapeutics," Adv Drug Deliv Rev 55 (2):171-97 (February 2003); von Mehren et al., "Monoclonal antibody therapy for cancer," *Annu Rev Med* 54:343-69 (2003); Epub Dec. 3, 2001; Hudson et al., "Engineered antibodies," *Nat Med* 9 (1):129-34 (January 2003); Brekke et al., "Therapeutic antibodies for human diseases at the dawn of the twenty-first century," *Nat Rev Drug Discov* 2 (1):52-62 (January 2003); Erratum in: *Nat Rev Drug Discov* 2 (3):240 (March 2003); Houdebine, "Antibody manufacture in transgenic animals and comparisons with other systems," *Curr Opin Biotechnol* 13 (6):625-9 (December 2002); Andreakos et al., "Monoclonal antibodies in immune and inflammatory diseases," *Curr Opin Biotechnol* 13 (6):615-20 (December 2002); Kellermann et al., "Antibody discovery: the use of transgenic mice to generate human monoclonal antibodies for therapeutics," *Curr Opin Biotechnol* 13 (6):593-7 (December 2002); Pini et al., "Phage display and colony filter screening for high-throughput selection of antibody libraries," *Comb Chem High Throughput Screen* 5 (7):503-10 (November 2002); Batra et al., "Pharmacokinetics and biodistribution of genetically engineered antibodies," *Curr Opin Biotechnol* 13 (6): 603-8 (December 2002); and Tangri et al., "Rationally engineered proteins or antibodies with absent or reduced immunogenicity," *Curr Med Chem* 9 (24):2191-9 (December 2002).

Uses of Antibodies

Antibodies can be used to isolate the variant proteins of the present invention from a natural cell source or from recombinant host cells by standard techniques, such as affinity chromatography or immunoprecipitation. In addition, antibodies are useful for detecting the presence of a variant protein of the present invention in cells or tissues to determine the pattern of expression of the variant protein among various tissues in an organism and over the course of normal development or disease progression. Further, antibodies can be used to detect variant protein in situ, in vitro, in a bodily fluid, or in a cell lysate or supernatant in order to evaluate the amount and pattern of expression. Also, antibodies can be used to assess abnormal tissue distribution, abnormal expression during development, or expression in an abnormal condition, such as in CVD, or during treatment. Additionally, antibody detection of circulating fragments of the full-length variant protein can be used to identify turnover.

Antibodies to the variant proteins of the present invention are also useful in pharmacogenomic analysis. Thus, antibodies against variant proteins encoded by alternative SNP alleles can be used to identify individuals that require modified treatment modalities.

Further, antibodies can be used to assess expression of the variant protein in disease states such as in active stages of the disease or in an individual with a predisposition to a disease related to the protein's function, such as CVD, or during the course of a treatment regime. Antibodies specific for a variant protein encoded by a SNP-containing nucleic acid molecule of the present invention can be used to assay for the presence of the variant protein, such as to diagnose CVD or to predict an individual's response to a treatment or predisposition/susceptibility to CVD, as indicated by the presence of the variant protein.

Antibodies are also useful as diagnostic tools for evaluating the variant proteins in conjunction with analysis by electrophoretic mobility, isoelectric point, tryptic peptide digest, and other physical assays well known in the art.

Antibodies are also useful for tissue typing. Thus, where a specific variant protein has been correlated with expression in a specific tissue, antibodies that are specific for this protein can be used to identify a tissue type.

Antibodies can also be used to assess aberrant subcellular localization of a variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of a variant protein, antibodies directed against the variant protein or relevant fragments can be used to monitor therapeutic efficacy.

The antibodies are also useful for inhibiting variant protein function, for example, by blocking the binding of a variant protein to a binding partner. These uses can also be applied in a therapeutic context in which treatment involves inhibiting a variant protein's function. An antibody can be used, for example, to block or competitively inhibit binding, thus modulating (agonizing or antagonizing) the activity of a variant protein. Antibodies can be prepared against specific variant protein fragments containing sites required for function or against an intact variant protein that is associated with a cell or cell membrane. For in vivo administration, an antibody may be linked with an additional therapeutic payload such as a radionuclide, an enzyme, an immunogenic epitope, or a cytotoxic agent. Suitable cytotoxic agents include, but are not limited to, bacterial toxin such as diphtheria, and plant toxin such as ricin. The in vivo half-life of an antibody or a fragment thereof may be lengthened by pegylation through conjugation to polyethylene glycol. Leong et al, *Cytokine* 16:106 (2001).

The invention also encompasses kits for using antibodies, such as kits for detecting the presence of a variant protein in a test sample. An exemplary kit can comprise antibodies such as a labeled or labelable antibody and a compound or agent for detecting variant proteins in a biological sample; means for determining the amount, or presence/absence of variant protein in the sample; means for comparing the amount of variant protein in the sample with a standard; and instructions for use.

Vectors and Host Cells

The present invention also provides vectors containing the SNP-containing nucleic acid molecules described herein. The term "vector" refers to a vehicle, preferably a nucleic acid molecule, which can transport a SNP-containing nucleic acid molecule. When the vector is a nucleic acid molecule, the SNP-containing nucleic acid molecule can be covalently linked to the vector nucleic acid. Such vectors include, but are not limited to, a plasmid, single or double stranded phage, a single or double stranded RNA or DNA viral vector, or artificial chromosome, such as a BAC, PAC, YAC, or MAC.

A vector can be maintained in a host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in prokaryotic or eukaryotic cells or in both (shuttle vectors).

Expression vectors typically contain cis-acting regulatory regions that are operably linked in the vector to the SNP-containing nucleic acid molecules such that transcription of the SNP-containing nucleic acid molecules is allowed in a host cell. The SNP-containing nucleic acid molecules can also be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region, a ribosome-binding site for translation. Other regulatory control elements for expression include initiation and termination codons as well as polyadenylation signals. A person of ordinary skill in the art would be aware of the numerous regulatory sequences that are useful in expression vectors. See, e.g., Sambrook and Russell, *Molecular Cloning: A Laboratory Manual*, Cold Spring Harbor Laboratory Press, N.Y. (2000).

A variety of expression vectors can be used to express a SNP-containing nucleic acid molecule. Such vectors include chromosomal, episomal, and virus-derived vectors, for example, vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors can also be derived from combinations of these sources such as those derived from plasmid and bacteriophage genetic elements, e.g., cosmids and phagemids. Appropriate cloning and expression vectors for prokaryotic and eukaryotic hosts are described in Sambrook and Russell, *Molecular Cloning: A Laboratory Manual*, Cold Spring Harbor Laboratory Press, N.Y. (2000).

The regulatory sequence in a vector may provide constitutive expression in one or more host cells (e.g., tissue specific expression) or may provide for inducible expression in one or more cell types such as by temperature, nutrient additive, or exogenous factor, e.g., a hormone or other ligand. A variety of vectors that provide constitutive or inducible expression of a nucleic acid sequence in prokaryotic and eukaryotic host cells are well known to those of ordinary skill in the art.

A SNP-containing nucleic acid molecule can be inserted into the vector by methodology well-known in the art. Generally, the SNP-containing nucleic acid molecule that will ultimately be expressed is joined to an expression vector by cleaving the SNP-containing nucleic acid molecule and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial host cells include, but are not limited to, *Escherichia coli*, *Streptomyces* spp., and *Salmonella typhimurium*. Eukaryotic host cells include, but are not limited to, yeast, insect cells such as *Drosophila* spp., animal cells such as COS and CHO cells, and plant cells.

As described herein, it may be desirable to express the variant peptide as a fusion protein. Accordingly, the invention provides fusion vectors that allow for the production of the variant peptides. Fusion vectors can, for example, increase the expression of a recombinant protein, increase the solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety. Proteolytic enzymes suitable for such use include, but are not limited to, factor Xa, thrombin, and enterokinase. Typical fusion expression vectors include pGEX (Smith et al., *Gene* 67:31-40 (1988)), pMAL (New England Biolabs, Beverly, Mass.) and pRIT5 (Pharmacia, Piscataway, N. J.) which fuse glutathione S-transferase (GST), maltose E binding protein, or protein A, respectively, to the target recombinant protein. Examples of suitable inducible non-fusion *E. coli* expression vectors include pTrc (Amann et al., *Gene* 69:301-315 (1988)) and pET 11d (Studier et al., *Gene Expression Technology: Methods in Enzymology* 185:60-89 (1990)).

Recombinant protein expression can be maximized in a bacterial host by providing a genetic background wherein the host cell has an impaired capacity to proteolytically cleave the recombinant protein (S. Gottesman, *Gene Expression Technology: Methods in Enzymology* 185:119-128, Academic Press, Calif. (1990)). Alternatively, the sequence of the SNP-containing nucleic acid molecule of interest can be altered to provide preferential codon usage for a specific host cell, for example, *E. coli*. Wada et al., *Nucleic Acids Res* 20:2111-2118 (1992).

The SNP-containing nucleic acid molecules can also be expressed by expression vectors that are operative in yeast. Examples of vectors for expression in yeast (e.g., *S. cerevisiae*) include pYepSec1 (Baldari et al., *EMBO J.* 6:229-234 (1987)), pMFa (Kurjan et al., *Cell* 30:933-943 (1982)), pJRY88 (Schultz et al., *Gene* 54:113-123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf 9 cells) include the pAc series (Smith et al., *Mol Cell Biol* 3:2156-2165 (1983)) and the pVL series (Lucklow et al., *Virology* 170:31-39 (1989)).

In certain embodiments of the invention, the SNP-containing nucleic acid molecules described herein are expressed in mammalian cells using mammalian expression vectors. Examples of mammalian expression vectors include pCDM8 (B. Seed, *Nature* 329:840 (1987)) and pMT2PC (Kaufman et al., *EMBO J.* 6:187-195 (1987)).

The invention also encompasses vectors in which the SNP-containing nucleic acid molecules described herein are cloned into the vector in reverse orientation, but operably linked to a regulatory sequence that permits transcription of antisense RNA. Thus, an antisense transcript can be produced to the SNP-containing nucleic acid sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include, for example, prokaryotic cells, lower eukaryotic cells such as yeast, other eukaryotic cells such as insect cells, and higher eukaryotic cells such as mammalian cells.

The recombinant host cells can be prepared by introducing the vector constructs described herein into the cells by techniques readily available to persons of ordinary skill in the art. These include, but are not limited to, calcium phosphate transfection, DEAE-dextran-mediated transfection, cationic lipid-mediated transfection, electroporation, transduction, infection, lipofection, and other techniques such as those described in Sambrook and Russell, *Molecular Cloning: A Laboratory Manual*, Cold Spring Harbor Laboratory, Cold Spring Harbor Laboratory Press, N.Y. (2000).

Host cells can contain more than one vector. Thus, different SNP-containing nucleotide sequences can be introduced in different vectors into the same cell. Similarly, the SNP-containing nucleic acid molecules can be introduced either alone or with other nucleic acid molecules that are not related to the SNP-containing nucleic acid molecules, such as those providing trans-acting factors for expression vectors. When more than one vector is introduced into a cell, the vectors can be introduced independently, co-introduced, or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication can occur in host cells that provide functions that complement the defects.

Vectors generally include selectable markers that enable the selection of the subpopulation of cells that contain the recombinant vector constructs. The marker can be inserted in the same vector that contains the SNP-containing nucleic acid molecules described herein or may be in a separate vector. Markers include, for example, tetracycline or ampicillin-resistance genes for prokaryotic host cells, and dihydrofolate reductase or neomycin resistance genes for eukaryotic host cells. However, any marker that provides selection for a phenotypic trait can be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

Where secretion of the variant protein is desired, which is difficult to achieve with multi-transmembrane domain containing proteins such as G-protein-coupled receptors (GPCRs), appropriate secretion signals can be incorporated into the vector. The signal sequence can be endogenous to the peptides or heterologous to these peptides.

Where the variant protein is not secreted into the medium, the protein can be isolated from the host cell by standard disruption procedures, including freeze/thaw, sonication, mechanical disruption, use of lysing agents, and the like. The variant protein can then be recovered and purified by well-known purification methods including, for example, ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that, depending upon the host cell in which recombinant production of the variant proteins described herein occurs, they can have various glycosylation patterns, or may be non-glycosylated, as when produced in bacteria. In addition, the variant proteins may include an initial modified methionine in some cases as a result of a host-mediated process.

For further information regarding vectors and host cells, see *Current Protocols in Molecular Biology*, John Wiley & Sons, N.Y.

Uses of Vectors and Host Cells, and Transgenic Animals

Recombinant host cells that express the variant proteins described herein have a variety of uses. For example, the cells are useful for producing a variant protein that can be further purified into a preparation of desired amounts of the variant protein or fragments thereof. Thus, host cells containing expression vectors are useful for variant protein production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function. Such an ability of a compound to modulate variant protein function may not be apparent from assays of the compound on the native/wild-type protein, or from cell-free assays of the compound. Recombinant host cells are also useful for assaying functional alterations in the variant proteins as compared with a known function.

Genetically-engineered host cells can be further used to produce non-human transgenic animals. A transgenic animal is preferably a non-human mammal, for example, a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more of its cell types or tissues. Such animals are useful for studying the function of a variant protein in vivo, and identifying and evaluating modulators of variant protein activity. Other examples of transgenic animals include, but are not limited to, non-human primates, sheep, dogs, cows, goats, chickens, and amphibians. Transgenic non-human mammals such as cows and goats can be used to produce variant proteins which can be secreted in the animal's milk and then recovered.

A transgenic animal can be produced by introducing a SNP-containing nucleic acid molecule into the male pronuclei of a fertilized oocyte, e.g., by microinjection or retroviral infection, and allowing the oocyte to develop in a pseudopregnant female foster animal. Any nucleic acid molecules that contain one or more SNPs of the present invention can potentially be introduced as a transgene into the genome of a non-human animal.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the variant protein in particular cells or tissues.

Methods for generating transgenic animals via embryo manipulation and microinjection, particularly animals such as mice, have become conventional in the art and are described, for example, in U.S. Pat. Nos. 4,736,866 and 4,870,009, both by Leder et al.; U.S. Pat. No. 4,873,191 by Wagner et al., and in B. Hogan, Manipulating the Mouse Embryo, Cold Spring Harbor Laboratory Press, N.Y. (1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes a non-human animal in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1. Lakso et al., *PNAS* 89:6232-6236 (1992). Another example of a recombinase system is the FLP recombinase system of *S. cerevisiae*. O'Gorman et al., *Science* 251:1351-1355 (1991). If a cre/loxP recombinase system is used to regulate expression of the transgene, animals containing transgenes encoding both the Cre recombinase and a selected protein are generally needed. Such animals can be provided through the construction of "double" transgenic animals, e.g., by mating two transgenic animals, one containing a transgene encoding a selected variant protein and the other containing a transgene encoding a recombinase.

Clones of the non-human transgenic animals described herein can also be produced according to the methods described, for example, in I. Wilmut et al., *Nature* 385:810-813 (1997) and PCT International Publication Nos. WO 97/07668 and WO 97/07669. In brief, a cell (e.g., a somatic cell) from the transgenic animal can be isolated and induced to exit the growth cycle and enter Go phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell (e.g., a somatic cell) is isolated.

Transgenic animals containing recombinant cells that express the variant proteins described herein are useful for conducting the assays described herein in an in vivo context. Accordingly, the various physiological factors that are present in vivo and that could influence ligand or substrate binding, variant protein activation, signal transduction, or other processes or interactions, may not be evident from in vitro cell-free or cell-based assays. Thus, non-human transgenic animals of the present invention may be used to assay in vivo variant protein function as well as the activities of a therapeutic agent or compound that modulates variant protein function/activity or expression. Such animals are also suitable for assessing the effects of null mutations (i.e., mutations that substantially or completely eliminate one or more variant protein functions).

For further information regarding transgenic animals, see Houdebine, "Antibody manufacture in transgenic animals and comparisons with other systems," *Curr Opin Biotechnol* 13 (6):625-9 (December 2002); Petters et al., "Transgenic animals as models for human disease," *Transgenic Res* 9 (4-5):347-51, discussion 345-6 (2000); Wolf et al., "Use of transgenic animals in understanding molecular mechanisms of toxicity," *J Pharm Pharmacol* 50 (6):567-74 (June 1998); Echelard, "Recombinant protein production in transgenic animals," *Curr Opin Biotechnol* 7 (5):536-40 (October 1996); Houdebine, "Transgenic animal bioreactors," *Transgenic Res* 9 (4-5):305-20 (2000); Pirity et al., "Embryonic stem cells, creating transgenic animals," *Methods Cell Biol* 57:279-93 (1998); and Robl et al., "Artificial chromosome vectors and expression of complex proteins in transgenic animals," *Theriogenology* 59 (1):107-13 (January 2003).

EXAMPLES

The following examples are offered to illustrate, but not limit, the claimed invention.

Example 1

SNP rs197922 in GOSR2 is Associated with Hypertension

Overview

A missense SNP in GOSR2 (Lys67Arg, rs197922) was analyzed for association with hypertension and blood pressure. Logistic and linear regression was used to test the association of the GOSR2 SNP with hypertension and blood pressure among 3,528 blacks and 9,861 whites from the Atherosclerosis Risk in Communities (ARIC) study. Race-specific regression models of hypertension were adjusted for age and gender. Adjustments were made for anti-hypertensive medication use when testing the association with blood pressure.

The Lys67 allele of GOSR2 was associated with increased hypertension risk in whites (adjusted odds ratio=1.09, P=0.01) (in blacks, adjusted odds ratio=0.96, P=0.47). The Lys67 allele was also associated with systolic blood pressure (SBP) in both races (adjusted $\beta$=0.87, P<0.001 and adjusted $\beta$=1.05, P=0.05 for whites and blacks, respectively). This allele was also associated with SBP in white participants of the Women's Health Study (P=0.11).

See Meyer et al., *Am J Hypertens*. 2009 February; 22 (2): 163-8, incorporated herein by reference in its entirety.

Methods

Atherosclerosis Risk in Communities Study (ARIC)

Study Population

The Atherosclerosis Risk in Communities (ARIC) study is a longitudinal cohort study of atherosclerosis, cardiovascular disease, and their risk factors. The population and study methods have been described in detail elsewhere.[12] Briefly, from 1987 to 1989, 15,792 participants between the ages of 45 to 64 were sampled from four study sites in the United States: Forsyth County, North Carolina; Jackson, Miss.; suburban Minneapolis, Minn.; and Washington County, Maryland. At baseline and in three-year intervals following the baseline visit (1990-1992, 1993-1995, and 1996-1998) participants were interviewed and underwent a brief clinical examination. The study was approved by institutional review boards from each field center and written informed consent was obtained from participants before each examination. Follow-up examinations were supplemented with annual telephone interviews.

In the current analysis, individuals from races other than white or black (n=48) or blacks from Minnesota and Washington County (n=55) were excluded due to small numbers. Those who refused to participate in genetic studies (n=44) were also excluded. Since incident CHD was the outcome used in the primary study in which GOSR2 was selected, and since results for hypertension were similar with or without exclusion for prevalent CHD, participants were excluded for prevalent CHD (n=762), missing CHD (337), or prevalent stroke (n=331), leaving 14,215 participants (10,401 whites, 3,814 blacks, 6,146 males and 8,069 females). During 196,069 person-years of follow-up (mean 13.8 years), 1,747 (12%) of the 14,215 ARIC participants in this analysis had an incident CHD event. For the present analysis of GOSR2 and hypertension, those missing information for GOSR2 genotype (n=826) were further excluded, resulting in 13,389 participants (9,861 whites, 3,528 blacks, 5,787 males and 7,602 females). At baseline, 4,416 of the 13,389 participants (33%) reported prevalent hypertension.

Measurements

Systolic blood pressure (SBP) and diastolic blood pressure (DBP) were measured after resting for 5 minutes in the seated position using a random-zero sphygmomanometer. Second and third readings were averaged to derive the blood pressure measures used here. Hypertension was defined as a SBP of 140 mmHg or greater, a DBP of 90 mmHg or greater, or use of blood pressure lowering medications in the past two weeks. Waist circumference was measured once at the umbilicus with an anthropometric tape. Levels of fasting triglycerides,[13] total cholesterol,[14] high density lipoprotein cholesterol (HDL),[15] and glucose[16] were measured in blood samples using standard methods that have been reported previously. Low density lipoprotein (LDL) cholesterol was calculated using the Friedewald formula.[17] Carotid artery (CA) intima media thickness (IMT) was measured using high-resolution B-mode ultrasound following structured protocols as described elsewhere.[18, 19] The mean of measurements taken at six carotid artery sites were used. High IMT was defined as $\geq 75\%$ tile separately for men and women. Diabetes was defined as a fasting blood glucose of 126 mg/dL or more, a non-fasting blood glucose of 200 mg/dL or more, self-reported diabetes, or use of diabetes medications in the past two weeks. Incident CHD was defined by documented MI, unstable angina, sudden coronary death, or non-elective cardiovascular surgical procedures. Incident CHD events were determined through 2003. Follow-up time for CHD events was calculated from the date of the baseline visit to the date of the first CHD event for CHD cases or until either Dec. 31, 2003 or the last date of contact for those who did not have a CHD event. Genotypes in the ARIC participants were determined by an oligonucleotide ligation procedure that combined PCR amplification of target sequences from 3 ng of genomic DNA with subsequent allele-specific oligonucleotide ligation.[20] The ligation products of the two alleles were separated by hybridization to product specific oligonucleotides, each coupled to spectrally distinct Luminex100 xMAP microspheres (Luminex, Austin, Tex.). The captured products were fluorescently labeled with streptavidin R-phycoerythrin (Prozyme, San Leandro, Calif.), sorted on the basis of microsphere spectrum, and detected by a Luminex100 instrument.

SNP Selection

SNPs were identified that were associated with CHD in two antecedent case control studies of MI. Briefly, 20,009 SNPs (in 9,874 Entrez or Ensembl genes) were tested in one case control study (475 cases of MI and 649 non-MI controls). The 1,548 SNPs that were associated with MI in this first study (P<0.1), were then tested in a second case-control study of MI (793 MI cases and 1,000 healthy controls). Further details of the antecedent case control studies can be found in other references.[21-23] 77 SNPs were found that were associated with MI (P<0.1) and had the same risk alleles in both studies (Table 7). The risk alleles of 72 of these 77 SNPs were then tested for their association with time to incident CHD in ARIC using Cox proportional hazards models, where the SNPs were modeled in an additive manner along with gender and age (five of the 77 SNPs were not tested in ARIC because good quality multiplex assays could not be made for them). One of the SNPs that was associated with CHD was in GOSR2 (Lys67Arg, rs197922). Complete results for the association tests between incident CHD in ARIC for 34 of the 72 SNPs are reported in Morrison et al.[23] and Bare et al.[22]

Statistics

Means and standard deviations or frequencies and percents were calculated for continuous and categorical variables, respectively. Triglyceride levels were natural-log transformed for comparison of mean levels by genotype. Mean systolic blood pressure (SBP) and diastolic blood pressure (DBP) were calculated excluding participants who were using anti-hypertensive medications. Differences in means or frequencies by genotype were determined using the F-test or chi-square test as appropriate for continuous and categorical variables. In all regression models, the GOSR2 SNP was coded in an additive manner. Linear regression was used to analyze the association between the GOSR2 SNP and the continuous variables, such as SBP and DBP. Logistic regression was used to analyze the association between the GOSR2 SNP and prevalent hypertension, elevated SBP, DBP, and IMT ($\geq 75\%$ tile). Linear and logistic regression models were adjusted for age and gender. Regression models of SBP and DBP were additionally adjusted for use of anti-hypertensive medications. Since additive models have been shown to perform well even when the underlying inheritance model is recessive or dominant,[24, 25] and since there is no previous literature indicating an inheritance model for the GOSR2 SNP and hypertension, estimates for the additive model for GOSR2 were reported. Differences in results by gender were evaluated using the likelihood ratio test. No significant differences by gender were detected, so gender-specific results are not presented. Power to detect an association between the GOSR2 SNP and hypertension with OR of 1.1 was 79% among white participants of ARIC and 45% among black participants.

Results

GOSR2 genotype frequencies differed by race (P<0.001; whites: ArgArg 43.2%, LysArg 44.6%, LysLys 12.2%; blacks: ArgArg 48.1%, LysArg 42.4%, LysLys 9.5%) but were consistent with Hardy-Weinberg expectations for both whites (Pearson chisquare=1.57; P=0.21) and blacks (Pearson chisquare=0.08; P=0.78).

Means and percentages for the demographic and clinical variables at baseline are presented in Table 8 according to race and genotype. Mean SBP (P=0.004) and DBP (P=0.09) among those not using anti-hypertensive medications, waist circumference (P=0.05), and CA IMT (P=0.02) differed by genotype among whites (there were no differences among blacks). The GOSR2 SNP was significantly associated with SBP in both whites ($\beta$=0.87, P<0.001) and blacks ($\beta$=1.05, P=0.05) after adjustment for age, gender, and use of anti-hypertensive medications. The GOSR2 SNP was also associated with DBP among whites after adjustment ($\beta$=0.37, P=0.01) (in blacks, after adjustment, $\beta$=0.44, P=0.14). Prevalent hypertension at baseline also differed by genotype among whites (P<0.01) (among blacks, P=0.66).

The risk associated with the GOSR2 SNP and blood pressure was assessed using dichotomized SBP and DBP variables (>75% tile). An association was found between the Lys67 allele of the GOSR2 SNP and elevated SBP (OR: 1.08; 95% CI: 1.00 to 1.15) and elevated DBP (OR: 1.08; 95% CI: 1.01 to 1.16) among whites (Table 9). The risk associated with GOSR2 and a dichotomized IMT variable was also assessed and found to be associated with elevated CA IMT (OR: 1.09; 95% CI: 1.01 to 1.17) among whites. The effect sizes were similar across measures of high blood pressure and consistent with the comparison of means by genotype in Table 8. In a genotypic assessment of the GOSR2 variant associated with hypertension among whites, the OR for LysArg compared to ArgArg and LysLys compared to ArgArg were similar in magnitude (OR: 1.18; 95% CI: 1.06 to 1.30 and OR: 1.13; 95% CI: 0.97 to 1.31, respectively), consistent with a dominant inheritance model for GOSR2 and hypertension in whites.

Discussion

The GOSR2 Lys67Arg SNP (rs197922) was analyzed for association with hypertension in the ARIC study and it was found that the Lys67 allele was associated with hypertension, as well as with elevated SBP and DBP. The Lys67 allele had been shown to be associated with increased risk of CHD in antecedent studies (Table 7). In this example, the GOSR2 Lys67 allele was found to be associated with increased occurrence of hypertension in white participants in the ARIC study (additive OR: 1.09; 95% CI: 1.02 to 1.17; dominance OR: 1.16; 95% CI 1.06 to 1.28). This Lys67 allele was also found to be associated with quantitative traits such as SBP, DBP, and CA IMT among whites in ARIC. Linear regression revealed that the Lys67 allele was also associated with SBP among black participants of ARIC after adjusting for age, gender, and use of anti-hypertensive medication.

The association between the Lys67 allele of GOSR2 and blood pressure was also tested in white participants of the Women's Health Study (WHS).[26] Allele frequencies of Lys67Arg in the white participants of WHS were similar to those of white participants of ARIC (data not shown). An association with increased SBP was observed for the Lys67 allele of GOSR2 in this WHS population (OR=1.03; P=0.04, in an ordinal logistic regression of nine SBP categories after adjusting for age) (OR=1.03 and P=0.11 after additionally adjusting for use of anti-hypertensive medications).

GOSR2

GOSR2 codes for a vesicular N-ethylmaleimide sensitive factor attachment protein receptor (v-SNARE) that is involved in intra-Golgi trafficking of vesicles.[29] v-SNAREs such as GOSR2 interact with target-localized SNAREs (t-SNAREs) to allow directed movement of macromolecules, such as insulin, leptin, and angiotensinogen, between Golgi compartments.[30-32] GOSR2 is expressed in multiple tissues.[7]

GOSR2 is located under linkage peaks with hypertension on human chromosome 17,[8-10] as well as the syntenic rat chromosome 10, and murine chromosome 11.[11] Despite the evidence in both humans and animal models for the region's contribution to blood pressure and risk of hypertension, an association between GOSR2 and hypertension has not previously been reported. Other genes in this region may be considered candidates for essential hypertension, but of these only MYL4 (myosin light polypeptide 4) is in a LD region with the GOSR2 rs197922 polymorphism. Using data from the International HapMap Project,[28] one SNP (rs16941671) from MYL4 was in moderate LD with GOSR2 rs197922 ($r^2$=0.19; D'=0.87) in the CEPH (Utah residents with ancestry from northern and western Europe) population.

Since GOSR2 codes for a vesicular membrane protein involved in intra-Golgi protein trafficking, the results described here indicate that protein processing in the Golgi influences blood pressure levels and risk of hypertension, and altered regulation of protein trafficking (such as may be attributable to a SNP such as rs197922 that can cause alternative amino acids to be encoded) within the Golgi may contribute to blood pressure and essential hypertension.

REFERENCES

Reference Numbers Corresponds to Example 1 Only, with the Exception of Reference Numbers 33 and 34 which Correspond to Table 7

1. Kearney P M, Whelton M, Reynolds K, Muntner P, Whelton P K, He J. Global burden of hypertension: Analysis of worldwide data. *Lancet.* 2005; 365:217-223.
2. Centers for Disease Control and Prevention. National Center for Health Statistics. FastStats.
3. Ostchega Y, Yoon S S, Hughes J, Louis T. Hypertension awareness, treatment and control—continued disparities in adults: United states, 2005-2006. 2008; NCHS data brief no 3. Hyatsville, Md.: National Center for Health Statistics.
4. Hajjar I, Kotchen T A. Trends in prevalence, awareness, treatment, and control of hypertension in the United States, 1988-2000. *JAMA.* 2003; 290:199-206.
5. Cowley A W, Jr. The genetic dissection of essential hypertension. *Nature Reviews Genetics.* 2006; 7:829-840.
6. Binder A. A review of the genetics of essential hypertension. *Curr Opin Cardiol.* 2007; 22: 176-184.
7. Lowe S L, Peter F, Subramaniam V N, Wong S H, Hong W. A SNARE involved in protein transport through the Golgi apparatus. *Nature.* 1997; 389:881-884.
8. Levy D, DeStefano A L, Larson M G, O'Donnell, C J, Lifton R P, Gavras H, Cupples L A, Myers R H. Evidence for a gene influencing blood pressure on chromosome 17. Genome scan linkage results for longitudinal blood pressure phenotypes in subjects from the Framingham heart study. *Hypertension.* 2000; 36:477-483.
9. Baima J, Nicolaou M, Schwartz F, DeStefano A L, Manolis A, Gavras I, Laffer C, Elijovich F, Farrer L, Baldwin C T, Gavras H. Evidence for linkage between essential hypertension and a putative locus on human chromosome 17. *Hypertension.* 1999; 34:4-7.
10. Julier C, Delepine M, Keavney B, Terwilliger J, Davis S, Weeks D E, Bui T, Jeunemaitre X, Velho G, Froguel P, Ratcliffe P, Corvol P, Soubrier F, Lathrop G M. Genetic susceptibility for human familial essential hypertension in a region of homology with blood pressure linkage on rat chromosome 10. *Hum Mol. Genet.* 1997; 6:2077-2085.

11. Knight J, Munroe P B, Pembroke J C, Caulfield M J. Human chromosome 17 in essential hypertension. *Ann Hum Genet.* 2003; 67:193-206.
12. The Atherosclerosis Risk in Communities (ARIC) study: Design and objectives. The ARIC investigators. *Am J Epidemiol.* 1989; 129:687-702.
13. Nagele U, Hagele E O, Sauer G, Wiedemann E, Lehmann P, Wahlefeld A W, Gruber W. Reagent for the enzymatic determination of serum total triglycerides with improved lipolytic efficiency. *Journal of Clinical Chemistry & Clinical Biochemistry.* 1984; 22:165-174.
14. Siedel J, Hagele E O, Ziegenhom J, Wahlefeld A W. Reagent for the enzymatic determination of serum total cholesterol with improved lipolytic efficiency. *Clin Chem.* 1983; 29:1075-1080.
15. Warnick G R, Benderson J, Albers J J. Dextran sulfate-Mg2+ precipitation procedure for quantitation of high-density-lipoprotein cholesterol. *Clin Chem.* 1982; 28: 1379-1388.
16. Operations manual no. 10: Clinical chemistry determinations, version 1.0; Chapel Hill: ARIC Coordinating Center, School of Public Health, University of North Carolina. 1987.
17. Friedewald W T, Levy R I, Fredrickson D S. Estimation of the concentration of low-density lipoprotein cholesterol in plasma, without use of the preparative ultracentrifuge. *Clin Chem.* 1972; 18:499-502.
18. Anonymous. High-resolution B-mode ultrasound scanning methods in the Atherosclerosis Risk in Communities study (ARIC). The ARIC study group. *Journal of Neuroimaging.* 1991; 1:68-73.
19. Stevens J, Tyroler H A, Cai J, Paton C C, Folsom A R, Tell G S, Schreiner P J, Chambless L E. Body weight change and carotid artery wall thickness. The Atherosclerosis Risk in Communities (ARIC) study. *Am J Epidemiol.* 1998; 147:563-573.
20. Shiffman D, O'Meara E S, Bare L A, Rowland C M, Louie J Z, Arellano A R, Lumley T, Rice K, Iakoubova O, Luke M M, Young B A, Malloy M J, Kane J P, Ellis S G, Tracy R P, Devlin J J, Psaty B M. Association of gene variants with incident myocardial infarction in the Cardiovascular Health Study. *Arterioscler Thromb Vasc Biol.* 2008:28: 173-179.
21. Shiffman D, Ellis S G, Rowland C M, Malloy M J, Luke M M, Iakoubova O A, Pullinger C R, Cassano J, Aouizerat B E, Fenwick R G, Reitz R E, Catanese J J, Leong D U, Zellner C, Sninsky J J, Topol E J, Devlin J J, Kane J P. Identification of four gene variants associated with myocardial infarction. *Am J Hum Genet.* 2005; 77:596-605.
22. Bare L A, Morrison A C, Rowland C M, Shiffman D, Luke M M, Iakoubova O A, Kane J P, Malloy M J, Ellis S G, Pankow J S, Willerson J T, Devlin J J, Boerwinkle E. Five common gene variants identify elevated genetic risk for coronary heart disease. *Genetics in Medicine.* 2007; 9:682-689.
23. Morrison A C, Bare L A, Chambless L E, Ellis S G, Malloy M, Kane J P, Pankow J S, Devlin J J, Willerson J T, Boerwinkle E. Prediction of coronary heart disease risk using a genetic risk score: The Atherosclerosis Risk in Communities study. *Am J Epidemiol.* 2007; 166:28-35.
24. Horvath S, Xu X, Laird N M. The family based association test method: Strategies for studying general genotype-phenotype associations. *European Journal of Human Genetics.* 2001; 9:301-306.
25. Balding D J. A tutorial on statistical methods for population association studies. *Nature Reviews Genetics.* 2006; 7:781-791.
26. Rexrode K M, Lee I M, Cook N R, Hennekens C H, Buring J E. Baseline characteristics of participants in the Women's Health Study. *Journal of Womens Health & Gender-Based Medicine.* 2000; 9:19-27.
27. Bui T D, Levy E R, Subramaniam V N, Lowe S L, Hong W. cDNA characterization and chromosomal mapping of human golgi SNARE GS27 and GS28 to chromosome 17. *Genomics.* 1999; 57:285-288.
28. The International HapMap Consortium. The International HapMap Project. *Nature.* 2003; 426:789-796.
29. Hay J C, Klumperman J, Oorschot V, Steegmaier M, Kuo C S, Scheller R H. Localization, dynamics, and protein interactions reveal distinct roles for E R and golgi SNAREs. *J Cell Biol.* 1998; 141:1489-1502.
30. Sollner T, Bennett M K, Whiteheart S W, Scheller R H, Rothman J E. A protein assembly-disassembly pathway in vitro that may correspond to sequential steps of synaptic vesicle docking, activation, and fusion. *Cell.* 1993; 75:409-418.
31. Sollner T, Whiteheart S W, Brunner M, Erdjument-Bromage H, Geromanos S, Tempst P, Rothman J E. SNAP receptors implicated in vesicle targeting and fusion. *Nature.* 1993; 362:318-324.
32. Rothman J E. Mechanisms of intracellular protein transport. *Nature.* 1994; 372:55-63.
33. Morrison A C, Bare L A, Chambless L E, Ellis S G, Malloy M, Kane J P, Pankow J S, Devlin J J, Willerson J T, Boerwinkle E. Prediction of coronary heart disease risk using a genetic risk score: The Atherosclerosis Risk in Communities study. *Am J Epidemiol.* 2007; 166:28-35.
34. Bare L A, Morrison A C, Rowland C M, Shiffman D, Luke M M, Iakoubova O A, Kane J P, Malloy M J, Ellis S G, Pankow J S, Willerson J T, Devlin J J, Boerwinkle E. Five common gene variants identify elevated genetic risk for coronary heart disease. *Genetics in Medicine.* 2007; 9:682-689.

Example 2

Identification of Five SNPs in Four Genes that are Associated with Myocardial Infarction Overview 17,576 SNPs that could affect gene function or expression were analyzed for association with MI. The testing of these SNPs was staged in three case-control studies of MI. In the first study (762 cases, 857 controls), 17,576 SNPs were tested and 1,949 SNPs were found that were associated with MI ($P<0.05$). These 1,949 SNPs were tested in a second study (579 cases and 1159 controls) and it was found that 24 of these SNPs were associated with MI (1-sided $P<0.05$) and had the same risk alleles in the first and second study. Finally, these 24 SNPs were tested in a third study (475 cases and 619 controls) and it was found that 5 of these SNPs, which are located in 4 genes (ENO1, FXN (2 SNPs), HLA-DPB2, and LPA), were associated with MI in the third study (1-sided $P<0.05$), and had the same risk alleles in all three studies.

Thus, 5 SNPs were identified that are associated with MI. See Shiffman et al., *PLoS ONE.* 2008 Aug. 6; 3 (8):e2895, incorporated herein by reference in its entirety.

Methods

Objectives

To identify genetic polymorphisms associated with MI, three case-control studies comprising cases with a history of MI and controls without a history of MI were interrogated. The first two case-control studies (Study 1 and Study 2) identified SNPs associated with MI. The hypotheses that these SNPs are associated with MI were tested in Study 3. The allele frequency of each SNP was determined in pools of case and control DNA prior to determining the genotype of a smaller number of SNPs for all individual DNA samples.

Participants

Participants in Study 1 and Study 2 were enrolled between July 1989 and May 2005 by the University of California, San Francisco (UCSF) Genomic Resource in Arteriosclerosis. UCSF samples received at the Celera genotyping facility by May 2004 were considered for inclusion in Study 1. Samples that arrived past that date were considered for Study 2. Cases in Study 1 and Study 2 included patients who had undergone diagnostic or interventional cardiac catheterization and patients of the UCSF Lipid Clinic. Controls were enrolled by the UCSF Genomic Resource in Arteriosclerosis and included UCSF staff, patients of UCSF Clinics, and senior citizens who participated in physical activities at regional community centers and events for senior citizens. A history of MI for Study 1 cases was verified by a clinical chart review or by *The International Classification of Diseases, 9th Revision* (ICD9) codes 410 or 411 in the patient records. MI status for Study 2 cases was determined by ICD9 codes 410 or 411 or by a self-reported history of MI. To characterize the accuracy of these self-reported histories, medical record review for a sample of Study 2 cases resulted in verification of the self-reported MI status for 98% of the sample (verification by electrocardiogram, cardiac enzymes or imaging). Controls had no history of MI, diabetes or symptomatic vascular disease. All participants of Study 1 and Study 2 chose Caucasian as their ethnicity in response to a multiple-choice questionnaire.

Participants in Study 3 were patients of the Cleveland Clinic Foundation (CCF) Heart Center who had undergone diagnostic or interventional cardiac catheterization between July 2001 and March 2003 and enrolled in the Genebank at Cleveland Clinic Study. A history of MI was verified by electrocardiogram, cardiac enzymes, or perfusion imaging. Controls had less than 50% coronary luminal narrowing. All participants in Study-3 selected North European, Eastern European, or 'other Caucasian' as the description of both their mother and father on the enrollment questionnaire. The demographic and risk factor characteristics of the participants in the 3 studies are presented in Table 11.

SNP Selection

The 17,576 SNPs investigated in Study 1 are located in 10,152 genes. These SNPs could potentially affect gene function or expression. Most (65%) of these SNPs were missense, nonsense, or were located in acceptor and donor splice sites. Other SNPs were located in transcription factor binding sites, microRNA binding sites, exon splice enhancer and silencer sites, or in untranslated regions of mRNA.

Allele Frequency and Genotype Determination

DNA concentrations were standardized to 10 ng/μL using PicoGreen (Molecular Probes) fluorescent dye. DNA pools, typically of 50 cases or controls, were made by mixing equal volumes of standardized DNA from each individual member of the pool. Each allele was amplified separately by PCR using 3 ng of pooled DNA. The allele frequency was calculated from amplification curves for each allele. At least four independent pools of DNA were amplified in duplicate for each allele. Genotyping of individual DNA samples was similarly performed using 0.3 ng of DNA.

Ethics

Subjects of all three studies gave informed consent and completed an Institutional Review Board approved questionnaire.

Statistical Methods

Association between MI status and allele frequencies was assessed by two-tailed $\chi^2$ tests, and between MI status and genotype by logistic regression using an additive inheritance model (Wald test). In Study 2 and Study 3, since a single prespecified risk allele was tested for each SNP, one-sided P values and 90% confidence intervals are presented (for odds ratios greater than one, there is 95% confidence that the true risk estimate is greater than the lower bound of a 90% confidence interval). A P threshold value of 0.05 was used in all three studies, and adjusted for multiple testing by calculating the false discovery rate (FDR) in Study 3. FDR was calculated using the MULTTEST procedure (SAS statistical package Version 9.1); for SNPs that were in the same gene, only the SNP with the higher (less significant) P value was included in the calculation.

Results

The allele frequencies of 17,576 putative functional SNPs were measured in Study 1 cases and controls using pooled DNA samples, and 1,949 SNPs were identified that were associated with MI (P<0.05) and had minor allele frequency estimates that were greater than 1%. For these 1,949 SNPs, allele frequencies in Study 2 cases and controls were determined using pooled DNA samples and it was verified that the risk allele identified in Study 1 was also associated with risk of MI in Study 2. For those SNPs that were associated with MI and had the same risk alleles in both pooling studies, the association of the SNP with MI in Study 1 and Study 2 was then confirmed by genotyping individual DNA samples. It was found that the risk alleles of 24 SNPs in 23 genes were associated with MI in both studies using an additive inheritance model (Table 12) and a P value threshold of 0.05. Next, the hypotheses that the risk alleles of these 24 SNPs would be associated with MI were tested in Study 3. It was found that the risk allele of 5 SNPs, in 4 genes (ENO1, FXN (2 SNPs), HLA-DPB2, and LPA) were associated with MI using an additive inheritance model after adjustment for age and sex (Table 13) (false discovery rate=0.23). The distribution of the genotypes for each of the SNPs did not deviate from what was expected under Hardy-Weinberg equilibrium (P>0.5). Further adjustment for traditional risk factors (dyslipidemia, hypertension, smoking status, and BMI), did not appreciably change the risk estimate for the four SNPs LPA, FXN (2 SNPs), and HLA-DPB2 (Table 13; for the ENO1 SNP, after further adjustment for traditional risk factors, OR=1.09, 90% CI 0.85-1.38, P=0.28, and the ENO1 SNP trended toward association with dyslipidemia (P=0.1)).

Discussion

An analysis was conducted of 17,576 SNPs that could potentially affect gene function or expression in three case-control studies of MI, and 5 SNPs were identified in four genes (ENO1, FXN (2 SNPs), HLA-DPB2, and LPA) that were associated with MI.

The first SNP is located in ENO1, a gene that encodes α-enolase, a glycolytic enzyme that catalyzes the conversion of 2-phospho-D-glycerate to phosphoenolpyruvate. α-enolase is also known to be a plasminogen receptor on the surface of hematopoietic cells and endothelial cells [11]. Thus, α-enolase could contribute to fibrinolysis, hemostasis, and arterial thrombus formation—processes that are critical in the pathophysiology of MI. The SNP in ENO1 (rs1325920) is located about 1 kb upstream of the gene and could be involved in transcriptional regulation.

Two of the SNPs are in the FXN gene. The FXN gene encodes Frataxin, a mitochondrial protein involved in maintaining cellular iron homeostasis [12]. Expanded GAA triplet repeats in intron 1 of FXN leads to silencing of the FXN gene and to accumulation of iron in the mitochondria, which makes mitochondria sensitive to oxidative stress [13]. These changes lead to Friedreich's ataxia, an autosomal recessive disease of the central nervous system that is frequently associated hypertrophic cardiomyopathy [12]. The two SNPs in FXN found to be associated with MI are located in the 3' untranslated region of FXN (rs 10890) and in a putative transcription factor binding site (rs3793456), thus one or both of these SNPs could have an effect on FXN gene expression. These two SNPs are in linkage disequilibrium ($r^2$=0.57 in Study 1).

The fourth SNP (rs3798220 in LPA) encodes a methionine to isoleucine substitution at amino acid 4399 of apolipoprotein(a). It has been previously shown that this SNP is associated with coronary artery narrowing and with increased levels of plasma lipoprotein(a) in case-control studies [10]. This SNP was also associated with incident myocardial infarction in the Cardiovascular Health Study, a population-based prospective study of about 5000 individuals aged 65 or older [14].

As described above, certain aspects of the invention relate to using SNP rs3798220 for utilities related to hormone replacement therapy (HRT).

The fifth SNP that is associated with MI in this study is in HLA-DPB2 (rs35410698). HLA-DPB2 is a pseudogene in the Human Leukocyte Antigen (HLA) region [15].

REFERENCES

Reference Numbers Correspond to Example 2 Only

1 American Heart Association (2002) Heart disease and stroke statistics: 2005 update. American Heart Association, Dallas
2. Marenberg M E, Risch N, Berkman L F, Floderus B, de Faire U (1994) Genetic susceptibility to death from coronary heart disease in a study of twins. N Engl J Med 330:1041-1046
3. Cohen J C, Boerwinkle E, Mosley T H Jr, Hobbs H H (2006) Sequence variations in PCSK9, low LDL, and protection against coronary heart disease. N Engl J Med 354: 1264-1272.
4. Kathiresan S, Melander O, Anevski D, Guiducci C, Burtt N P et al. (2008) Polymorphisms associated with cholesterol and risk of cardiovascular events. N Engl J Med 358:1240-1249.
5. McPherson R, Pertsemlidis A, Kavaslar N, Stewart A, Roberts R et al. (2007) A common allele on chromosome 9 associated with coronary heart disease. Science 316:1488-1491.
6. Helgadottir A, Thorleifsson G, Manolescu A, Gretarsdottir S, Blondal T et al. (2007) A common variant on chromosome 9p21 affects the risk of myocardial infarction. Science 316:1491-1493.
7. Shiffman D, Rowland C M, Sninsky J J, Devlin J J (2006) Polymorphisms associated with coronary heart disease: better by the score. Curr Opin Mol Ther 8:493-499.
8. Shiffman D, Ellis S G, Rowland C M, Malloy M J, Luke M M et al. (2005) Identification of four gene variants associated with myocardial infarction. Am J Hum Genet. 77:596-605.
9. Shiffman D, Rowland C M, Louie J Z, Luke M M, Bare L A et al. (2006) Gene Variants of VAMP8 and HNRPUL1 Are Associated With Early-Onset Myocardial Infarction. Arterioscler Thromb Vasc Biol 26:1613-1618.
10. Luke M M, Kane J P, Liu D M, Rowland C M, Shiffman D et al. (2007) A polymorphism in the protease-like domain of apolipoprotein(a) is associated with severe coronary artery disease. Arterioscler Thromb Vasc Biol 27:2030-2036.
11. Pancholi V. (2001) Multifunctional alpha-enolase: its role in diseases. Cell Mol Life Sci 58:902-920.
12. Gottesfeld J M (2007) Small molecules affecting transcription in Friedreich ataxia. Pharmacol Ther 116:236-248.
13. Al-Mahdawi S, Pinto R M, Varshney D, Lawrence L, Lowrie M B et al. (2006) Genomics 88:580-590.
14. Shiffman D, O'Meara E S, Bare L A, Rowland C M, Louie J Z et al. (2008) Association of Gene Variants With Incident Myocardial Infarction in the Cardiovascular Health Study. Arterioscler Thromb Vasc Biol 28:173-179.
15. de Bakker P I, McVean G, Sabeti P C, Miretti M M, Green T et al. (2006) A high-resolution HLA and SNP haplotype map for disease association studies in the extended human MHC. Nat Genet 38:1166-1172.
16. Topol E J, McCarthy J, Gabriel S, Moliterno D J, Rogers W J et al. (2001) Single nucleotide polymorphisms in multiple novel thrombospondin genes may be associated with familial premature myocardial infarction. Circulation 104:2641-2644.

Example 3

Fine-Mapping SNPs Associated with CVD

SNPs Surrounding GOSR2 SNP rs197922 (hCV2275273)
As described above in Example 1, a SNP in GOSR2 (rs197922, hCV2275273) was identified as being associated with MI. In order to determine if there are other SNPs that are also associated with MI in the region of chromosome 17 surrounding this GOSR2 SNP, other SNPs in a 215 kb region surrounding rs197922 were genotyped and analyzed. This region of 215 kb included all the SNPs with $r^2$>0.3 with rs197922 based on Hapmap Caucasian population. SNPs in this region were interrogated using tagging SNPs. SNPs which tagged other SNPs in this region with $r^2$>0.8 were genotyped in samples from UCSF Study 1 ("UCSF1") (793 MI cases and 1000 controls). For SNPs that were in LD with rs197922 ($r^2$>0.3), tagging SNPs with $r^{2>0.90}$ were used. SNPs that were significantly associated with MI (1-sided p-value of <0.05) in UCSF1 are provided in Table 10.

SNPs Surrounding ENO1 SNP rs1325920 (hCV8824241)
As described above in Example 2, a SNP in ENO1 (rs1325920, hCV8824241) was identified as being associated with MI. In order to determine if there are other SNPs that are also associated with MI in the region of chromosome 1 surrounding this ENO1 SNP, other SNPs in a 582 kb region surrounding rs1325920 were genotyped and analyzed. This region of 582 kb included all the SNPs with $r^{2>0.3}$ with rs1325920 based on Hapmap Caucasian population. SNPs in this region were interrogated using tagging SNPs. SNPs which tagged other SNPs in this region with $r^2$>0.8 were genotyped in samples from UCSF1 (762 MI cases and 857 controls). For SNPs that were in LD with rs1325920 ($r^2$>0.3), tagging SNPs with $r^2$>0.90 were used. Some of the SNPs that were associated with MI in UCSF1 were also genotyped in a second sample set, UCSF2 (579 MI cases and 1159 controls).

SNPs that were significantly associated with MI (1-sided p-value of <0.05) in UCSF1 and were also associated with MI in UCSF2 (or were not tested in UCSF2) are provided in Table 14.

SNPs Surrounding FXN SNP rs10890 (hCV1463226)

As described above in Example 2, a SNP in FXN (rs10890, hCV1463226) was identified as being associated with MI. In order to determine if there are other SNPs that are also associated with MI in the region of chromosome 9 surrounding this FXN SNP, other SNPs in a 203 kb region surrounding rs10890 were genotyped and analyzed. This region of 203 kb included all the SNPs with $r^2>0.3$ with rs10890 based on Hapmap Caucasian population. SNPs in this region were interrogated using tagging SNPs. SNPs which tagged other SNPs in this region with $r^2>0.8$ were genotyped in samples from UCSF1 (762 MI cases and 857 controls). For SNPs that were in LD with rs10890 ($r^2>0.3$), tagging SNPs with $r^2>0.90$ were used. Some of the SNPs that were associated with MI in UCSF1 were also genotyped in a second sample set, UCSF2 (579 MI cases and 1159 controls). SNPs that were significantly associated with MI (1-sided p-value of <0.05) in UCSF1 and were also associated with MI in UCSF2 (or were not tested in UCSF2) are provided in Table 15.

SNPs Surrounding RERE SNP rs10779705 (hCV32055477)

As shown in Table 14 (SNPs surrounding ENO1), a SNP in RERE (rs10779705, hCV32055477) was been identified as being associated with MI. In order to determine if there are other SNPs that are also associated with MI in the region of chromosome 1 surrounding this RERE SNP, other SNPs in a 596 kb region surrounding rs10779705 were genotyped and analyzed. This region of 596 kb included all the SNPs with $r^2>0.3$ with rs10779705 based on Hapmap Caucasian population. SNPs in this region were interrogated using tagging SNPs. SNPs which tagged other SNPs in this region with $r^2>0.8$ were genotyped in samples from UCSF1 (762 MI cases and 857 controls). For SNPs that were in LD with rs10779705 ($r^2>0.3$), tagging SNPs with $r^2>0.90$ were used. SNPs that were significantly associated with MI (1-sided p-value of <0.05) in UCSF1 are provided in Table 16.

SNPs Surrounding VAMP8 SNP rs1001 (hCV2091644)

A SNP in VAMP8 (rs1001, hCV2091644) has been identified as being associated with MI. In order to determine if there are other SNPs that are also associated with MI in the region of chromosome 2 surrounding this VAMP8 SNP, other SNPs in a 220 kb region surrounding rs1010 were genotyped and analyzed. This region of 220 kb included all the SNPs with $r^2>0.3$ with rs1001 based on Hapmap Caucasian population. SNPs in this region were interrogated using tagging SNPs. SNPs which tagged other SNPs in this region with $r^2>0.8$ were genotyped in samples from UCSF1 (793 MI cases and 1000 controls). For SNPs that were in LD with rs1010 ($r^2>0.3$), tagging SNPs with $r^2>0.90$ were used. SNPs that were significantly associated with MI (1-sided p-value of <0.05) in UCSF1 are provided in Table 17.

SNPs Surrounding LPA SNP rs3798220 (hCV25930271)

As described above in Example 2, a SNP in LPA (rs3798220, hCV25930271) was identified as being associated with MI. In order to determine if there are other SNPs that are also associated with MI in the region of chromosome 6 surrounding this LPA SNP, other SNPs in a 442 kb region surrounding rs3798220 (between rs9355797 and rs1950562) were genotyped and analyzed. This region of 442 kb included all the SNPs with $r^2>0.2$ with rs3798220 based on Hapmap Caucasian population. SNPs in this region were interrogated using tagging SNPs. SNPs which tagged other SNPs in this region with $r^2>0.8$ were genotyped in samples from UCSF1 (762 MI cases and 857 controls). SNPs that were significantly associated with MI (1-sided p-value of <0.05) in UCSF1 are provided in Table 18.

In a further analysis of SNPs in this 442 kb region surrounding rs3798220, SNPs were analyzed for association with MI risk using a meta-analysis of two case-control studies of MI, the UCSF1 and USCF2 studies. As indicated in the preceding paragraph, the UCSF1 study included 762 MI cases and 857 controls. The UCSF2 study included 579 MI cases and 1159 controls. In both the UCSF1 and UCSF2 studies, cases had a confirmed history of MI and controls had no history of CHD. A meta-analysis of the UCSF1 and UCSF2 studies was also used to analyze whether these SNPs are also associated with Lp(a) levels (Lpa level was transformed to Log 10Lpa). SNPs that were significantly associated (p-value of <0.1) with both MI risk and Lp(a) levels in the meta-analysis of the UCSF1 and UCSF2 studies are provided in Table 19.

Example 4

SNPs (from a Functional Genome Scan) Associated with CVD in Two Studies

SNPs identified in a functional genome scan (FGS) were analyzed for their association with CVD, particularly MI. For these SNPs, genetic data from two case-control studies of MI were analyzed without stratification. In one study, UCSF1, there were 762 cases and 857 controls. In the second study, UCSF2, there were 579 cases and 1159 controls. In both studies, cases had a confirmed history of MI and controls had no history of CHD. SNPs showing significant (p-value of <0.1) association with MI risk in both studies are provided in Table 20.

Example 5

SNPs Associated with Response to Statin Therapy and with Risk for CVD in the CARE Study The CARE ("Cholesterol and Recurrent Events") study, which is a randomized multicentral double-blinded trial of secondary prevention of MI with pravastatin (Pravachol®) in individuals who have previously had an MI, is described in Sacks et al. (1991) *Am. J. Cardiol.* 68: 1436-1446 and Sacks et al. (1996) *New England Journal of Medicine* 335: 1001-1009. The CARE trial, including an analysis of SNPs therein, is also described in Iakoubova et al., "Association of the Trp719Arg polymorphism in kinesin-like protein 6 with myocardial infarction and coronary heart disease in 2 prospective trials: the CARE and WOSCOPS trials", *J Am Coll Cardiol.* 2008 Jan. 29; 51 (4):435-43.

A well-documented MI was one of the enrollment criteria for entry into the CARE study. Patients were enrolled in the CARE trial from 80 participating study centers. Men and post-menopausal women were eligible for the trial if they had had an acute MI between 3 and 20 months prior to randomization, were 21 to 75 years of age, and had plasma total cholesterol levels of less than 240 mg/deciliter, LDL cholesterol levels of 115 to 174 mg/deciliter, fasting triglyceride levels of less than 350 mg/deciliter, fasting glucose levels of no more than 220 mg/deciliter, left ventricular ejection fractions of no less than 25%, and no symptomatic congestive heart failure. Patients were randomized to receive either 40 mg of pravastatin once daily or a matching placebo. The primary endpoint of the CARE trial was death from a coronary event or nonfatal MI and the median duration of follow-up was 5.0 years (range, 4.0 to 6.2 years). For the study of CARE described in this Example and shown in Tables 21-22, two endpoints were investigated: the primary endpoint of CARE (a composite endpoint of fatal coronary event or nonfatal MI, and identified as "endpt1" in the Endpoint column of Tables 21-22) and a composite endpoint of confirmed fatal or nonfatal MI (identified as "rmi" in the Endpoint column of Tables 21-22).

Table 21 provides SNPs associated with reduction of CHD risk, particularly risk for MI and recurrent MI, by Pravastatin in the CARE study, and Table 22 provides SNPs associated with risk of CHD, particularly risk for MI and recurrent MI, in the placebo arm of the CARE study. The SNPs provided in Table 22 are a subset of the SNPs provided in Table 21; thus, the SNPs provided in Table 22 are associated with both increased CHD risk as well as reduction of CHD risk by statin treatment (e.g., Pravastatin).

Specifically, Table 21 provides SNPs for which the effect of pravastatin on the primary endpoint of the CARE study (identified as "endpt1" in the Endpoint column) or the recurrent MI endpoint (identified as "rmi" in the Endpoint column) was analyzed by genotype subgroups and for which pravastatin reduced risk in one genotype subgroup but not in another (P-interaction between statin treatment and genotype for the enpdpoint<0.1).

Table 22 provides a subset of SNPs from Table 21 that were associated (p<0.1) with time to occurrence of first event, either the CARE primary endpoint ("endpt1") or recurrent MI endpoint ("rmi"), in the placebo group of the CARE study. In Table 22, the HR (including lower and upper confidence intervals) and p-values indicated for each SNP correspond to Allele 1 (Allele 2 is the reference allele, which is considered to have HR=1).

HR stands for Hazard Ratio, which is a concept similar to Odds Ratio (OR). The HR in event-free survival analysis is the effect of an explanatory variable on the hazard or risk of an event. For examples, HR describes the likelihood of developing MI based on comparison of rate of coronary events between carriers of a certain allele and noncarriers of the allele; therefore, HR=1.5 would mean that carriers of the allele have 50% higher risk of coronary events during the study follow-up than non-carriers. HR can also describe the effect of statin therapy on coronary events based on comparison of the rate of coronary events between patients treated with statin and patients treated with placebo in subgroups defined by SNP genotype; therefore, HR=0.5 would mean that, for example, carriers of a certain allele had a 50% reduction of coronary events by statin therapy as compared to placebo. In Table 21, p-interaction values were calculated. An interaction (or effect modification) is formed when a third variable modifies the relation between an exposure and outcome. A p-interaction<0.1 indicates that a third variable (genotype) modifies the relation between an exposure (statin treatment) and outcome (CARE primary endpoint or recurrent MI). Genotype and drug interaction is present when the effect of statins (incidence rate of disease in statin-treated group, as compared to placebo) differs in patients with different genotypes.

Example 6

Calculated Linkage Disequilibrium (LD) SNPs Associated with CVD

Another investigation was conducted to identify additional SNPs that are calculated to be in linkage disequilibrium (LD) with certain "interrogated SNPs" that have been found to be associated with CVD (particularly CHD, especially MI, or hypertension), as described herein and shown in the tables. The interrogated SNPs are shown in column 1 (which indicates the hCV identification numbers of each interrogated SNP) and column 2 (which indicates the public rs identification numbers of each interrogated SNP) of Table 6. The methodology is described earlier in the instant application. To summarize briefly, the power threshold (T) was set at an appropriate level, such as 51%, for detecting disease association using LD markers. This power threshold is based on equation (31) above, which incorporates allele frequency data from previous disease association studies, the predicted error rate for not detecting truly disease-associated markers, and a significance level of 0.05. Using this power calculation and the sample size, a threshold level of LD, or $r^2$ value, was derived for each interrogated SNP ($r_T^2$, equations (32) and (33) above). The threshold value $r_T^2$ is the minimum value of linkage disequilibrium between the interrogated SNP and its LD SNPs possible such that the non-interrogated SNP still retains a power greater or equal to T for detecting disease association.

Based on the above methodology, LD SNPs were found for the interrogated SNPs. Several exemplary LD SNPs for the interrogated SNPs are listed in Table 6; each LD SNP is associated with its respective interrogated SNP. Also shown are the public SNP IDs (rs numbers) for the interrogated and LD SNPs, when available, and the threshold $r^2$ value and the power used to determine this, and the $r^2$ value of linkage disequilibrium between the interrogated SNP and its corresponding LD SNP. As an example in Table 6, the interrogated SNP rs2145270 (hCV10048483) was calculated to be in LD with rs1000972 (hCV10048484) at an $r^2$ value of 0.9242, based on a 51% power calculation, thus establishing the latter SNP as a marker associated with CVD as well.

In general, the threshold $r_T^2$ value can be set such that one of ordinary skill in the art would consider that any two SNPs having an $r^2$ value greater than or equal to the threshold $r_T^2$ value would be in sufficient LD with each other such that either SNP is useful for the same utilities, such as determining an individual's risk for CVD such as CHD (particularly MI) or hypertension. For example, in various embodiments, the threshold $r_T^2$ value used to classify SNPs as being in sufficient LD with an interrogated SNP (such that these LD SNPs can be used for the same utilities as the interrogated SNP, for example) can be set at, for example, 0.7, 0.75, 0.8, 0.85, 0.9, 0.95, 0.96, 0.97, 0.98, 0.99, 1, etc. (or any other $r^2$ value in-between these values). Threshold $r_T^2$ values may be utilized with or without considering power or other calculations.

All publications and patents cited in this specification are herein incorporated by reference in their entirety. Modifications and variations of the described compositions, methods and systems of the invention will be apparent to those skilled in the art without departing from the scope and spirit of the invention. Although the invention has been described in connection with specific preferred embodiments and certain working examples, it should be understood that the invention as claimed should not be unduly limited to such specific embodiments. Indeed, various modifications of the above-described modes for carrying out the invention that are obvious to those skilled in the field of molecular biology, genetics and related fields are intended to be within the scope of the following claims.

TABLE 5

| Marker | Alleles | Primer 1 (Allele-Specific Primer) | Primer 2 (Allele-Specific Primer) | Common Primer |
|---|---|---|---|---|
| hCV10048483 | C/T | ACAGCGTTTGACACTTCG (SEQ ID NO: 4007) | AACAGCGTTTGACACTTCA (SEQ ID NO: 4008) | GAACTAGGAGCAGAGGAGAGACTA (SEQ ID NO: 4009) |
| hCV1026586 | A/G | GTCCAGCTTAATAATTAACTTGTCAAA (SEQ ID NO: 4010) | TCCAGCTTAATAATTAACTTGTCAAAT (SEQ ID NO: 4011) | GCCATGAGCTCATTGCCTACAA (SEQ ID NO: 4012) |
| hCV1030264 | A/G | AGGTAGATATCGTGGCTAAGAT (SEQ ID NO: 4013) | GGTAGATATCGTGGCTAAGAC (SEQ ID N0: 4014) | CGTCTTCTCGGATGTCATAGTGC (SEQ ID NO: 4015) |
| hCV1116794 | A/G | GTGAGTTCTCAGATGGTTGA (SEQ ID NO: 4016) | TGAGTTCTCAGATGGTTGG (SEQ ID NO: 4017) | GCTTCAAGCTGTTGACAGTG (SEQ ID NO: 4018) |
| hCV11170747 | A/G | AATTTTTCATTCTGCATGTGTT (SEQ ID NO: 4019) | AATTTTTCATTCTGCATGTGTC (SEQ ID NO: 4020) | CCAGGGCTCTTTCAAGATAGTA (SEQ ID NO: 4021) |
| hCV11181829 | C/T | GATGGAGTTTTGAGGAACC (SEQ ID NO: 4022) | CGATGGAGTTTTGAGGAACT (SEQ ID NO: 4023) | CCCTGGGCAGAATCAGA (SEQ ID NO: 4024) |
| hCV11225994 | A/G | TCCCAATCCCAGGACA (SEQ ID NO: 4025) | CCCAATCCCAGGACG (SEQ ID NO: 4026) | TGACATTGCACTCTCAAATATTT (SEQ ID NO: 4027) |
| hCV11231076 | C/T | AGTCATGGTGGACGGTG (SEQ ID NO: 4028) | CAGTCATGGTGGACGGTA (SEQ ID NO: 4029) | CTTGGTGCTGTCCTCACTGTAGTA (SEQ ID NO: 4030) |
| hCV11276368 | C/T | CGCGGAGTGTCAAGAGG (SEQ ID NO: 4031) | CGCGGAGTGTCAAGAGA (SEQ ID NO: 4032) | ACCTTGGGCAAAAATACAT (SEQ ID NO: 4033) |
| hCV11315168 | C/G | GTTGTTTGCTTCATCTCTGC (SEQ ID NO: 4034) | GTTGTTTGCTTCATCTCTGG (SEQ ID NO: 4035) | AGTGCTGGGCTCAAGAAC (SEQ ID NO: 4036) |
| hCV11315171 | C/T | ATTTCTGAATAACTGAAGTTGGTC (SEQ ID NO: 4037) | ATTTCTGAATAACTGAAGTTGGTT (SEQ ID NO: 4038) | CCCTACCTGGGTTATCAGTAAT (SEQ ID NO: 4039) |
| hCV11398434 | C/T | AATGAAATCTAGGAATAGTGACCAC (SEQ ID NO: 4040) | CAATGAAATCTAGGAATAGTGACCAT (SEQ ID NO: 4041) | CTTCAGCCCAAGAGTTTGAGACTA (SEQ ID NO: 4042) |
| hCV11398437 | C/T | AGAGTATGTGTAATTAAGTCGCTAC (SEQ ID NO: 4043) | AAGAGTATGTGTAATTAAGTCGCTAT (SEQ ID NO: 4044) | ACTGAGGATGAGTAATTATGTCTTATT AGGACCATAG (SEQ ID NO: 4045) |
| hCV11433557 | G/C | TGATGAGTGTCGAAATGGAG (SEQ ID NO: 4046) | TGATGAGTGTCGAAATGGAC (SEQ ID NO: 4047) | ACCGGTTCTGCTTTGATAAC (SEQ ID NO: 4048) |
| hCV11438723 | C/T | ACGCGTGTCTTTCTCAC (SEQ ID NO: 4049) | ACGCGTGTCTTTCTCAT (SEQ ID NO: 4050) | AAGTTACTTAAAATCTGCTTTTTCTTA G (SEQ ID NO: 4051) |
| hCV11445935 | G/T | GGCTGAAATTATTCCAATAAAGGAC (SEQ ID NO: 4052) | GGCTGAAATTATTCCAATAAAGGAA (SEQ ID NO: 4053) | ACCAGGCTGTTGACCTTGCTATAA (SEQ ID NO: 4054) |
| hCV11461296 | C/G | GACTGAGGCCCACGC (SEQ ID NO: 4055) | GACTGAGGCCCACGG (SEQ ID NO: 4056) | GGGTCTGCAGGTTAACAACA (SEQ ID NO: 4057) |
| hCV11466079 | A/G | CCCATACCCAAGGAACCTT (SEQ ID NO: 4058) | CCCATACCCAAGGAACCTC (SEQ ID NO: 4059) | GGATCAGCCAAGCCAGACTT (SEQ ID NO: 4060) |
| hCV11466848 | A/G | CTGGACTTCTGGGTCCT (SEQ ID NO: 4061) | TGGACTTCTGGGTCCC (SEQ ID NO: 4062) | CAAGAAGCTGAGCGAGTGTCT (SEQ ID NO: 4063) |
| hCV11504800 | A/T | TAACAATTTGGTTTATATCCTCCCT (SEQ ID NO: 4064) | ACAATTTGGTTTATATCCTCCCA (SEQ ID NO: 4065) | CAGCTCTACATAGTATCCTGGAGAGAC (SEQ ID NO: 4066) |
| hCV11513719 | C/T | TCCTCCGGTGTCAGTTTAG (SEQ ID NO: 4067) | TCCTCCGGTGTCAGTTTAA (SEQ ID NO: 4068) | GCAGTGGCCAGGGTTCAT (SEQ ID NO: 4069) |
| hCV11568668 | A/G | CTTTCACTCACTCAACACATACTTA (SEQ ID NO: 4070) | TTCACTCACTCAACACATACTTG (SEQ ID NO: 4071) | GCTCAGTTGGGAGATGTGTAGGTA (SEQ ID NO: 4072) |
| hCV11592758 | T/C | CATCCAACAGCTCTTCTATCAT (SEQ ID NO: 4073) | CATCCAACAGCTCTTCTATCAC (SEQ ID NO: 4074) | CAAACATCCGAGGACAAG (SEQ ID NO: 4075) |
| hCV11623551 | C/T | ACTCTTTGATGGCAACCATG (SEQ ID NO: 4076) | TTAACTCTTTGATGGCAACCATA (SEQ ID NO: 4077) | GGTTTTAAGCCAGCACTCTTAGACT (SEQ ID NO: 4078) |
| hCV11628130 | T/A | CTGCCCTCTTTTTAGCAGA (SEQ ID NO: 4079) | CTGCCCTCTTTTTAGCAGT (SEQ ID NO: 4080) | CCCTTTCTCATTCATTCATTTT (SEQ ID NO: 4081) |

TABLE 5-continued

| Marker | Alleles | Primer 1 (Allele-Specific Primer) | Primer 2 (Allele-Specific Primer) | Common Primer |
|---|---|---|---|---|
| hCV11642651 | C/T | AAGGATGGCCTCATCAG (SEQ ID NO: 4082) | AAGGATGGCCTCATCAA (SEQ ID NO: 4083) | CCAGGATGGAGATGAAGAGA (SEQ ID NO: 4084) |
| hCV11678789 | G/T | CCACTGAAATGCTACTTTGAGTAAC (SEQ ID NO: 4085) | CCACTGAAATGCTACTTTGAGTAAA (SEQ ID NO: 4086) | AGACAATCTGAGACATGCGAAGACT (SEQ ID NO: 4087) |
| hCV11688401 | A/G | CCCTTTCCCAGGCTTATT (SEQ ID NO: 4088) | CCCTTTCCCAGGCTTATC (SEQ ID NO: 4089) | CCTCAACCAGGAAGTCGAGAG (SEQ ID NO: 4090) |
| hCV11689916 | A/T | TGTGAGTGGGCCTTCACT (SEQ ID NO: 4091) | GTGAGTGGGCCTTCACA (SEQ ID NO: 4092) | GGAGCCCCGCTTCAT (SEQ ID NO: 4093) |
| hCV11697322 | A/G | CAGTTCGTGCTATTGAGAAAAT (SEQ ID NO: 4094) | CAGTTCGTGCTATTGAGAAAAC (SEQ ID NO: 4095) | CAAAGAAAAACAGATCACACAGAT (SEQ ID NO: 4096) |
| hCV1170305 | C/T | GCACAGAAAGCCGTGAG (SEQ ID NO: 4097) | GCACAGAAAGCCGTGAA (SEQ ID NO: 4098) | CTGTAAGCTCCTCTGGTTCAG (SEQ ID NO: 4099) |
| hCV11761245 | C/T | ACACACTTCACAATGGACG (SEQ ID NO: 4100) | CACACACTTCACAATGGACA (SEQ ID NO: 4101) | CAGTAAACCTGGCACTCTTCAGTAGT (SEQ ID NO: 4102) |
| hCV11764545 | G/T | CGAAGCTTCCGAGGAAG (SEQ ID NO: 4103) | CGAAGCTTCCGAGGAAT (SEQ ID NO: 4104) | GACACCGGACGAGAGAGAC (SEQ ID NO: 4105) |
| hCV11765753 | A/G | GAGAAAAAGAACAGATGTCCTT (SEQ ID NO: 4106) | GAGAAAAAGAACAGATGTCCTC (SEQ ID NO: 4107) | TGATGCCTCTCAGCATTTATAC (SEQ ID NO: 4108) |
| hCV11846435 | C/T | GCTGGGAACCTCTATCCC (SEQ ID NO: 4109) | GCTGGGAACCTCTATCCT (SEQ ID NO: 4110) | GGGCTCATGAGGAAAGTTTATGTG (SEQ ID NO: 4111) |
| hCV11854426 | C/T | CATAATGATGTTGGTAGGGTCG (SEQ ID NO: 4112) | CATAATGATGTTGGTAGGGTCA (SEQ ID NO: 4113) | CCAGATTGATTCATGCTCCTCTCAC (SEQ ID NO: 4114) |
| hCV11856381 | A/G | CAATGGTGGGCATGTCTTAT (SEQ ID NO: 4115) | AATGGTGGGCATGTCTTAC (SEQ ID NO: 4116) | GAGGGCTAAAGGAAAGAGGTGTTCT (SEQ ID NO: 4117) |
| hCV11864162 | A/C | CCCTTTGCCTTGTCGTT (SEQ ID NO: 4118) | CCCTTTGCCTTGTCGTG (SEQ ID NO: 4119) | CACTGCACCAGGCCTAGAAATAC (SEQ ID NO: 4120) |
| hCV1188731 | C/T | GGCAGATAGTAGCTGTTCAATAAAC (SEQ ID NO: 4121) | GGCAGATAGTAGCTGTTCAATAAAT (SEQ ID NO: 4122) | TTTGGGTAGCAGATCACTTCATTAATCTGA (SEQ ID NO: 4123) |
| hCV1188735 | C/T | CTTGCTCTGATAAGAACTTTACAAC (SEQ ID NO: 4124) | CCTTGCTCTGATAAGAACTTTACAAT (SEQ ID NO: 4125) | CTGCCGTGGCCTTTCAAAG (SEQ ID NO: 4126) |
| hCV1188747 | C/G | TGAAAATGTTCCTGAGCTATGG (SEQ ID NO: 4127) | TGAAAATGTTCCTGAGCTATGC (SEQ ID NO: 4128) | ACTATCACCCAGAAGGCGATCATAC (SEQ ID NO: 4129) |
| hCV11955747 | A/C | AAAGGGAAGGAGGTTACTTACT (SEQ ID NO: 4130) | AGGGAAGGAGGTTACTTACG (SEQ ID NO: 4131) | TCCTCTGTGGAGAGGGATAC (SEQ ID NO: 4132) |
| hCV11960994 | A/G | TTTGTAAACACACAGAGATGATAAT (SEQ ID NO: 4133) | TTTGTAAACACACAGAGATGATAAC (SEQ ID NO: 4134) | TTTCCGCTCGACATGTAA (SEQ ID NO: 4135) |
| hCV11972326 | C/G | TTCTTTTAAAGGATTGGTAAACTC (SEQ ID NO: 4136) | TTCTTTTAAAGGATTGGTAAACTG (SEQ ID NO: 4137) | AGAGCAGAACGAGGTTTTATTT (SEQ ID NO: 4138) |
| hCV12020339 | G/T | GGACCCCCGAAGGC (SEQ ID NO: 4139) | TGGACCCCCGAAGGA (SEQ ID NO: 4140) | GGCCCCAACAGTTGACTG (SEQ ID NO: 4141) |
| hCV12022345 | A/T | AGTGGCCTCATCCTCCT (SEQ ID NO: 4142) | GTGGCCTCATCCTCCA (SEQ ID NO: 4143) | GAACGCTTACGAGCCTTATC (SEQ ID NO: 4144) |
| hCV12034662 | A/G | GGGGCTATGTAGACTACATCTTTA (SEQ ID NO: 4145) | GGGCTATGTAGACTACATCTTTG (SEQ ID NO: 4146) | TTCAACAATGCGTTGGCAAGAGAT (SEQ ID NO: 4147) |
| hCV12107274 | C/T | TGATGCTAATCTGTTCTCTGTG (SEQ ID NO: 4148) | TCTGATGCTAATCTGTTCTCTGTA (SEQ ID NO: 4149) | ATAACAAGAGGAAGGAGATCAGA (SEQ ID NO: 4150) |
| hCV12108469 | A/G | TCGTGTCTACCTTAGGGTACA (SEQ ID NO: 4151) | CGTGTCTACCTTAGGGTACG (SEQ ID NO: 4152) | CGTATGGCTTCAGGATGTC (SEQ ID NO: 4153) |
| hCV1239369 | A/C | GAAGATGTTACTCCTAATATCATACAGT (SEQ ID NO: 4154) | AAGATGTTACTCCTAATATCATACAGG (SEQ ID NO: 4155) | GTTGTACCCTCATTGTGACATTAGGT (SEQ ID NO: 4156) |

TABLE 5-continued

| Marker | Alleles | Primer 1 (Allele-Specific Primer) | Primer 2 (Allele-Specific Primer) | Common Primer |
|---|---|---|---|---|
| hCV1243283 | A/G | TTATTCCTAGTTCCAATGAAAGAT (SEQ ID NO: 4157) | TTATTCCTAGTTCCAATGAAAGAC (SEQ ID NO: 4158) | GCCTCTTGGGAGTACTCACTT (SEQ ID NO: 4159) |
| hCV1253630 | A/G | TCGCAGGTGTCCCTA (SEQ ID NO: 4160) | CGCAGGTGTCCCTG (SEQ ID NO: 4161) | CCCCATCCCTTCTCA (SEQ ID NO: 4162) |
| hCV1323634 | C/T | GAAGTGAAATAATGGTTCAGCATAC (SEQ ID NO: 4163) | GAAGTGAAATAATGGTTCAGCATAT (SEQ ID NO: 4164) | CTGCATCTGTTGAGATTATTGTATGAC GTT (SEQ ID NO: 4165) |
| hCV1323669 | A/G | GTGTTATACTGTATCACTCTTCTTTTC TAA (SEQ ID NO: 4166) | TGTTATACTGTATCACTCTTCTTTTCT AG (SEQ ID NO: 4167) | GGGGGCGGAACTTAGACA (SEQ ID NO: 4168) |
| hCV1345898 | C/T | CAGTTTTCCATGGGTTCTACTAC (SEQ ID NO: 4169) | CAGTTTTCCATGGGTTCTACTAT (SEQ ID NO: 4170) | TTATGAAATGGTACAGACAAGTGAT (SEQ ID NO: 4171) |
| hCV1361979 | A/G | CCAGTTTTGGTGTCAACTAGAAA (SEQ ID NO: 4172) | CCAGTTTTGGTGTCAACTAGAAG (SEQ ID NO: 4173) | TTGCAACCTGAAAAACATAACTA (SEQ ID NO: 4174) |
| hCV1366867 | A/G | GGAGCCAGGCCTACAT (SEQ ID NO: 4175) | GGAGCCAGGCCTACAC (SEQ ID NO: 4176) | CGCCTCGACGAGATTCT (SEQ ID NO: 4177) |
| hCV1375141 | C/T | CCTTCGGAGTTGCACAG (SEQ ID NO: 4178) | CCTTCGGAGTTGCACAA (SEQ ID NO: 4179) | TTTTTGGTGGGTTTCTCTGTA (SEQ ID NO: 4180) |
| hCV1415464 | C/G | CCCTGGGGGTCTTTC (SEQ ID NO: 4181) | CCCTGGGGGTCTTTG (SEQ ID NO: 4182) | CCGTGGCCTCTGTGATT (SEQ ID NO: 4183) |
| hCV1449414 | T/C | ACACACATATGGTGGTTCATAAT (SEQ ID NO: 4184) | CACACATATGGTGGTTCATAAC (SEQ ID NO: 4185) | CATGTCCCAGCTCTTCTTG (SEQ ID NO: 4186) |
| hCV1449416 | T/A | TATGCAAGGTGTTGTTATAGATTT (SEQ ID NO: 4187) | GTATGCAAGGTGTTGTTATAGATTA (SEQ ID NO: 4188) | GCGTTGTAACTGAGTTCATTATTC (SEQ ID NO: 4189) |
| hCV1463112 | C/T | TTCAAGCTATTTGTAGTTCCTAGAG (SEQ ID NO: 4190) | CTTCAAGCTATTTGTAGTTCCTAGAA (SEQ ID NO: 4191) | GGTGTGGCCTTCTTTGGAAGATC (SEQ ID NO: 4192) |
| hCV1463184 | C/T | GGTTAAATGACACTCTTTGGGG (SEQ ID NO: 4193) | GGTTAAATGACACTCTTTGGGA (SEQ ID NO: 4194) | GTTTCAGAAAGATTTGTCAGGACCACT (SEQ ID NO: 4195) |
| hCV1463222 | C/T | TGTTTCTCCCACATATTCACAC (SEQ ID NO: 4196) | CTGTTTCTCCCACATATTCACATAT (SEQ ID NO: 4197) | CGCTACATCACTCAGCTCATGAAA (SEQ ID NO: 4198) |
| hCV1463224 | C/T | CAACTCACACGGGAAGAC (SEQ ID NO: 4199) | CAACTCACACGGGAAGAT (SEQ ID NO: 4200) | GTGAATATGTGGGAGAAACAGCACTAG (SEQ ID NO: 4201) |
| hCV1463226 | C/T | ATTTCCTCCCTCACATGATAC (SEQ ID NO: 4202) | ATTTCCTCCCTCACATGATAT (SEQ ID NO: 4203) | TCAAAGAATGAAGAGTGAAGACA (SEQ ID NO: 4204) |
| hCV1488444 | G/T | TCAACAGAATGCCATGAGC (SEQ ID NO: 4205) | GTCAACAGAATGCCATGAGA (SEQ ID NO: 4206) | CAAGGCAGAAGTAGTTGTCCAACAG (SEQ ID NO: 4207) |
| hCV1489995 | C/G | GAGGCGAAAGGAACAGAG (SEQ ID NO: 4208) | GAGGCGAAAGGAACAGAC (SEQ ID NO: 4209) | GCGTGCTGAGGAGTAATGTAC (SEQ ID NO: 4210) |
| hCV1550877 | C/T | GGTCCAAATAGACTAACTTTAAGTGAC (SEQ ID NO: 4211) | GGTCCAAATAGACTAACTTTAAGTAT (SEQ ID NO: 4212) | CCCACACAACATACAATTTACAAATGC (SEQ ID NO: 4213) |
| hCV1552894 | A/G | CAGATTCAGCCTCCCAA (SEQ ID NO: 4214) | CAGATTCAGCCTCCCAG (SEQ ID NO: 4215) | GCAGTTGGAAATCTGAATTTC (SEQ ID NO: 4216) |
| hCV1552900 | A/G | GGGATGGAAGAGCTTCA (SEQ ID NO: 4217) | GGGATGGAAGAGCTTCG (SEQ ID NO: 4218) | CTGCAGCCTTCCTCTGAC (SEQ ID NO: 4219) |
| hCV15746640 | A/G | GAAACGGCTGGTTTGTGT (SEQ ID NO: 4220) | AACGGCTGGTTTGTGC (SEQ ID NO: 4221) | TCCAATCTACCTTTTCCTTGTATT (SEQ ID NO: 4222) |
| hCV15752705 | C/G | GCCTCCCCTGCTGC (SEQ ID NO: 4223) | GGCCTCCCCTGCTGG (SEQ ID NO: 4224) | AGGTCCCTTCTGCTGTAATG (SEQ ID NO: 4225) |
| hCV15752716 | C/T | ACGCTGCTGTTCCG (SEQ ID NO: 4226) | CACGCTGCTGTTCCA (SEQ ID NO: 4227) | CAGACAGACAACAATTCAGAAGAA (SEQ ID NO: 4228) |
| hCV15758290 | G/A | GTCACACACCCAGGAGC (SEQ ID NO: 4229) | GGTCACACACCCAGGAGT (SEQ ID NO: 4230) | GGATGATTGCCATAATGAGTC (SEQ ID NO: 4231) |

TABLE 5-continued

| Marker | Alleles | Primer 1 (Allele-Specific Primer) | Primer 2 (Allele-Specific Primer) | Common Primer |
|---|---|---|---|---|
| hCV15760070 | A/T | TGTCCAGATCCACATAGAACA (SEQ ID NO: 4232) | TTGTCCAGATCCACATAGAACT (SEQ ID NO: 4233) | CTTTATGCAGCGGACCAT (SEQ ID NO: 4234) |
| hCV15770510 | C/T | ACGGCATCTTCTATCCG (SEQ ID NO: 4235) | CACGGCATCTTCTATCCA (SEQ ID NO: 4236) | CCAGCTGGTGGTGAGTG (SEQ ID NO: 4237) |
| hCV15851335 | C/T | GATGGCATGGATGGC (SEQ ID NO: 4238) | GGATGGCATGGATGGT (SEQ ID NO: 4239) | GCAGGATGTGCTGTGATTAT (SEQ ID NO: 4240) |
| hCV15851779 | A/G | CAACCTGACATGGAAGAAAT (SEQ ID NO: 4241) | CAACCTGACATGGAAGAAAC (SEQ ID NO: 4242) | GATGTGGTGGGATTTGACAT (SEQ ID NO: 4243) |
| hCV15870728 | C/T | GAGAGAGAACAGCCAGAC (SEQ ID NO: 4244) | GAGAGAGAACAGCCAGAT (SEQ ID NO: 4245) | GCATCCCAGGTCAAGGTA (SEQ ID NO: 4246) |
| hCV15871150 | A/G | CCCAAATTCTGCATAGCATAA (SEQ ID NO: 4247) | CCCAAATTCTGCATAGCATAG (SEQ ID NO: 4248) | GTGGGCTCGGGTCTCTA (SEQ ID NO: 4249) |
| hCV15874689 | A/G | TGGAAAGCCTCAAGTCT (SEQ ID NO: 4250) | GGAAAGCCTCAAGTCC (SEQ ID NO: 4251) | TTCTAGAGGTGGTCAGCTAATACTT (SEQ ID NO: 4252) |
| hCV15876011 | T/G | ACCATCAGTTACCTTCATGACT (SEQ ID NO: 4253) | CATCAGTTACCTTCATGACG (SEQ ID NO: 4254) | GCGGACCACCTGTTAATC (SEQ ID NO: 4255) |
| hCV15882274 | G/A | CATGGAGATCCAAGTCG (SEQ ID NO: 4256) | ACATGGAGATCCAAGTCA (SEQ ID NO: 4257) | GACTCAGGCAGGACAACC (SEQ ID NO: 4258) |
| hCV15885004 | A/G | CTCCCCTACTCTGCTCATATAT (SEQ ID NO: 4259) | CTCCCCTACTCTGCTCATATAC (SEQ ID NO: 4260) | CATTCTCCCCACCAGGCATTTAT (SEQ ID NO: 4261) |
| hCV15892430 | C/T | ACTGAGAGCTTGTCCTCAG (SEQ ID NO: 4262) | ACTGAGAGCTTGTCCTCAA (SEQ ID NO: 4263) | CACACCCAGAGACCACAGG (SEQ ID NO: 4264) |
| hCV15954277 | A/G | TGTCGGTAAACATGGCA (SEQ ID NO: 4265) | GTCGGTAAACATGGCG (SEQ ID NO: 4266) | GGTGGGTGGTCTGACTCTC (SEQ ID NO: 4267) |
| hCV15954645 | A/T | CTGATGGTATTTTACAGTGGATCA (SEQ ID NO: 4268) | CTGATGGTATTTTACAGTGGATCT (SEQ ID NO: 4269) | AAGACGCAACGAGCTTTGTGT (SEQ ID NO: 4270) |
| hCV15955388 | C/T | TGCATTACTCGGACCC (SEQ ID NO: 4271) | CTGCATTACTCGGACCT (SEQ ID NO: 4272) | TGCCCGCACCTTGTC (SEQ ID NO: 4273) |
| hCV15963535 | C/G | GTTGCTCATAGTTGCTGGC (SEQ ID NO: 4274) | GTTGCTCATAGTTGCTGGG (SEQ ID NO: 4275) | CAGCATCTTCGACAGAGACA (SEQ ID NO: 4276) |
| hCV15963962 | A/G | TACTGTCCCGTGTTCCA (SEQ ID NO: 4277) | CTGTCCCGTGTTCCG (SEQ ID NO: 4278) | CTCTCCCAGAGCCCTCTAG (SEQ ID NO: 4279) |
| hCV15963994 | G/T | GCTGCGTTTCTACTCTGC (SEQ ID NO: 4280) | TGCTGCGTTTCTACTCTGA (SEQ ID NO: 4281) | ACTCATGCGCATGCACATAAACA (SEQ ID NO: 4282) |
| hCV15965796 | C/G | CGCCCTGCACTTTCAC (SEQ ID NO: 4283) | CGCCCTGCACTTTCAG (SEQ ID NO: 4284) | CCGTGCTCTACTGCTTCTCTA (SEQ ID NO: 4285) |
| hCV15967490 | C/T | TGGAGGGTCCAACTCATAAC (SEQ ID NO: 4286) | TGGAGGGTCCAACTCATAAT (SEQ ID NO: 4287) | GGGATTGCTCAGCATCTCCTTAAAT (SEQ ID NO: 4288) |
| hCV15973230 | A/G | TCACTGATGTCAATGAACACT (SEQ ID NO: 4289) | ACTGATGTCAATGAACACC (SEQ ID NO: 4290) | CCCATCCCAGAGTTCTTGTC (SEQ ID NO: 4291) |
| hCV1600754 | C/T | ATTTCCCTGGGAAGACTTC (SEQ ID NO: 4292) | ATTTCCCTGGGAAGACTTT (SEQ ID NO: 4293) | CTAGTGGTGGAAGGAAATGTTA (SEQ ID NO: 4294) |
| hCV1603697 | C/T | CGGCCTGCGTGGAC (SEQ ID NO: 4295) | CGGCCTGCGTGGAT (SEQ ID NO: 4296) | GCCCAGGGCGTGTTCT (SEQ ID NO: 4297) |
| hCV16044337 | A/G | TCCGGGTGCACGTATA (SEQ ID NO: 4298) | CGGGTGCACGTATG (SEQ ID NO: 4299) | TGGAGAGTGTTTGCTCATCTAC (SEQ ID NO: 4300) |
| hCV16047108 | A/G | TGTTTTCATCCACTTGAACTGT (SEQ ID NO: 4301) | TTTTCATCCACTTGAACTGC (SEQ ID NO: 4302) | CAATTTTGGCTCCCTTAAAAG (SEQ ID NO: 4303) |
| hCV16065831 | C/T | CTCCTGACTGTGAACAACTTATC (SEQ ID NO: 4304) | CTCCTGACTGTGAACAACTTATT (SEQ ID NO: 4305) | CCCCCAGTTGTGCATACAC (SEQ ID NO: 4306) |

TABLE 5-continued

| Marker | Alleles | Primer 1 (Allele-Specific Primer) | Primer 2 (Allele-Specific Primer) | Common Primer |
|---|---|---|---|---|
| hCV16140621 | A/T | AGCTGAAAGGAGAAGTCAGT (SEQ ID NO: 4307) | AGCTGAAAGGAGAAGTCAGA (SEQ ID NO: 4308) | CCCTGCTACGAAGGTGGAATATCT (SEQ ID NO: 4309) |
| hCV16172339 | A/T | CTGCGGCTCCACCT (SEQ ID NO: 4310) | TGCGGCTCCACCA (SEQ ID NO: 4311) | TGGCATCTGCCATACTCA (SEQ ID NO: 4312) |
| hCV16173091 | T/C | CACAGACTTGATGTTTTTGAAAGT (SEQ ID NO: 4313) | CAGACTTGATGTTTTTGAAAGC (SEQ ID NO: 4314) | TGCAAAGGAAGCAACTTCA (SEQ ID NO: 4315) |
| hCV16179493 | C/T | GGGTCCGGCCACAC (SEQ ID NO: 4316) | GGGTCCGGCCACAT (SEQ ID NO: 4317) | GGGCCCCTCAGTGAAG (SEQ ID NO: 4318) |
| hCV16179599 | C/T | CTGCTCTCAGAACCTCAGTC (SEQ ID NO: 4319) | CTGCTCTCAGAACCTCAGTT (SEQ ID NO: 4320) | CACTGCAGGGAAATAGAGAAA (SEQ ID NO: 4321) |
| hCV16179628 | A/G | CAGGTTCACTGTTTCTCCAAT (SEQ ID NO: 4322) | CAGGTTCACTGTTTCTCCAAC (SEQ ID NO: 4323) | GAGCACATCCTTCCATTGTAA (SEQ ID NO: 4324) |
| hCV16182835 | A/G | TGTTCTTCCTTATGATGATGT (SEQ ID NO: 4325) | GTTCTTCCTTATGATGATGC (SEQ ID NO: 4326) | GGCGTTCCTCTCACCTTAATA (SEQ ID NO: 4327) |
| hCV16186452 | C/T | GGCACCCCGACAG (SEQ ID NO: 4328) | GGCACCCCGACAA (SEQ ID NO: 4329) | TCCTTATGCTCTCAGTGAAGTTC (SEQ ID NO: 4330) |
| hCV16189421 | C/T | GCCATCATTTGCTTCTAACAC (SEQ ID NO: 4331) | GCCATCATTTGCTTCTAACAT (SEQ ID NO: 4332) | GCTTATTTGCCAGAAAACATTT (SEQ ID NO: 4333) |
| hCV16192174 | G/A | GAGCACCTTAACTATAGATGGTG (SEQ ID NO: 4334) | TGAGCACCTTAACTATAGATGGTA (SEQ ID NO: 4335) | CTTGTCAAGGCACAGAATAATT (SEQ ID NO: 4336) |
| hCV16196618 | C/G | ATTAGCCCCAAAGCGTAC (SEQ ID NO: 4337) | ATTAGCCCCAAAGCGTAG (SEQ ID NO: 4338) | GCTTTAGAAGGCTGGATATTTATG (SEQ ID NO: 4339) |
| hCV1639938 | A/C | AGTGGAGCTTCAGGGCT (SEQ ID NO: 4340) | TGGAGCTTCAGGGCG (SEQ ID NO: 4341) | CAGTGGAGACAGAGGATGTTTAC (SEQ ID NO: 4342) |
| hCV1643239 | C/T | CCAGAGTCCACAGAAAGTTTC (SEQ ID NO: 4343) | CCAGAGTCCACAGAAAGTTTT (SEQ ID NO: 4344) | GAAAATAACGCAAGCAGTTTC (SEQ ID NO: 4345) |
| hCV1647371 | C/T | CTGGCTGGGTCACTAACC (SEQ ID NO: 4346) | GCTGGCTGGGTCACTAACT (SEQ ID NO: 4347) | CCTCACCTGCATTCACATTT (SEQ ID NO: 4348) |
| hCV1682755 | C/T | TGTTCTCAATGAATCAAAGCTATTAC (SEQ ID NO: 4349) | CATGTTCTCAATGAATCAAAGCTATTAT (SEQ ID NO: 4350) | GTCTTCCCCATGTTCATACTCTTGT (SEQ ID NO: 4351) |
| hCV1690777 | A/G | GGCTTTACAGAAGGAAATGCT (SEQ ID NO: 4352) | GCTTTACAGAAGGAAATGCC (SEQ ID NO: 4353) | GCATGCGCTGAATTTTATATAG (SEQ ID NO: 4354) |
| hCV1729928 | A/G | GGAAATTGTTGAGTGTTTGTAAAGT (SEQ ID NO: 4355) | GGAAATTGTTGAGTGTTTGTAAAGC (SEQ ID NO: 4356) | CAATGCCCAAAGTTGGCTATGATT (SEQ ID NO: 4357) |
| hCV1741111 | C/T | CCTCAGAATGGCCAAAAC (SEQ ID NO: 4358) | CCTCAGAATGGCCAAAAT (SEQ ID NO: 4359) | CCAGGCAGCCAGACTTCT (SEQ ID NO: 4360) |
| hCV1770462 | A/G | GCACCTCTGGGTGAAGAATA (SEQ ID NO: 4361) | CACCTCTGGGTGAAGAATG (SEQ ID NO: 4362) | GGCACAGGCAAGTCTGATT (SEQ ID NO: 4363) |
| hCV1782711 | C/T | CCACTGCTGCAAGGAGTC (SEQ ID NO: 4364) | CCACTGCTGCAAGGAGTT (SEQ ID NO: 4365) | GCAGTCATCATATGGACAACTTAC (SEQ ID NO: 4366) |
| hCV1801149 | A/G | GAGAGTCGCAGGGTATTTAA (SEQ ID NO: 4367) | GAGAGTCGCAGGGTATTTTAG (SEQ ID NO: 4368) | AAAGGCCCAGGCTCTAGA (SEQ ID NO: 4369) |
| hCV1802755 | C/T | CTCCTTAAGAAGAATGCCACC (SEQ ID NO: 4370) | TCTCCTTAAGAAGAATGCCACT (SEQ ID NO: 4371) | AGCCAGTTTAGCATTTACTCTTTACAAG (SEQ ID NO: 4372) |
| hCV1843175 | A/C | CCCCGAAGCCTATGGCT (SEQ ID NO: 4373) | CCCGAAGCCTATGGCG (SEQ ID NO: 4374) | CGTCAGCACCCAACTCTG (SEQ ID NO: 4375) |
| hCV1844077 | A/G | CCCTAAATGCAGAAATTGAATCTT (SEQ ID NO: 4376) | CCCTAAATGCAGAAATTGAATCTC (SEQ ID NO: 4377) | CCCTCTGAAATGCTGCTGTAACT (SEQ ID NO: 4378) |
| hCV1948599 | A/C | GCAGTTTGAGTATAAATTGTTTGACTA (SEQ ID NO: 4379) | GCAGTTTGAGTATAAATTGTTTGACTC (SEQ ID NO: 4380) | CAGTGACAGATGAGTGCAGAGAAT (SEQ ID NO: 4381) |

TABLE 5-continued

| Marker | Alleles | Primer 1 (Allele-Specific Primer) | Primer 2 (Allele-Specific Primer) | Common Primer |
|---|---|---|---|---|
| hCV2002654 | C/G | GGAGCCCCAGGAAAG (SEQ ID NO: 4382) | GGAGCCCCAGGAAAC (SEQ ID NO: 4383) | AGAGCCCTCGGTTCTTG (SEQ ID NO: 4384) |
| hCV2038 | G/A | CACGGCGGTCATGTG (SEQ ID NO: 4385) | CCACGGCGGTCATGTA (SEQ ID NO: 4386) | GGTGGAGCTTGGTTTCTCA (SEQ ID NO: 4387) |
| hCV207123 | C/G | TGTAGATCATGTGGATGGATTG (SEQ ID NO: 4388) | AATGTAGATCATGTGGATGGATTC (SEQ ID NO: 4389) | CTGTCAGGCTGTCTGTAAGTCTCTAT (SEQ ID NO: 4390) |
| hCV2091644 | C/T | TTCTGGGGCATACAACG (SEQ ID NO: 4391) | CTTCTGGGGCATACAACA (SEQ ID NO: 4392) | AGGGACAACCCTCCATAAA (SEQ ID NO: 4393) |
| hCV2091649 | A/G | CCTCAGAGTATGTGCCCA (SEQ ID NO: 4394) | CCTCAGAGTATGTGCCCG (SEQ ID NO: 4395) | GCCCGGCTGCATCTAGTT (SEQ ID NO: 4396) |
| hCV2091650 | C/T | TCTCTGAGCTGAGTGCC (SEQ ID NO: 4397) | GTCTCTGAGCTGAGTGCT (SEQ ID NO: 4398) | TCCCTATCCTAACTCTCCTTGTCT (SEQ ID NO: 4399) |
| hCV2091669 | A/T | GTCAGTAGCGCTCACTTTT (SEQ ID NO: 4400) | GTCAGTAGCGCTCACTTTA (SEQ ID NO: 4401) | GGCTACTTAGCTGCAGTTCAAACTC (SEQ ID NO: 4402) |
| hCV2091674 | G/T | CCACTTAATAACAACACTACTTGC (SEQ ID NO: 4403) | GCCACTTAATAACAACACTACTTGA (SEQ ID NO: 4404) | GACTGAGCCTGTTTCCTCACCTATAA (SEQ ID NO: 4405) |
| hCV2143205 | A/G | TGTCGAATGGGAGTCTTCTT (SEQ ID NO: 4406) | TGTCGAATGGGAGTCTTCTC (SEQ ID NO: 4407) | CCTAGTAGTACAACGGAAGAAACAG (SEQ ID NO: 4408) |
| hCV2146578 | C/T | CCTCCTAGAGAAGATCTGCAC (SEQ ID NO: 4409) | CCTCCTAGAGAAGATCTGCAT (SEQ ID NO: 4410) | AAGGCCCCTCTTCTGTCT (SEQ ID NO: 4411) |
| hCV2146579 | A/C | TTCCTAACAGAGGCTTGGA (SEQ ID NO: 4412) | TCCTAACAGAGGCTTGGC (SEQ ID NO: 4413) | TGCAGTGTCCCCTAGAATG (SEQ ID NO: 4414) |
| hCV2192261 | C/T | CCTACCTTGAATTCACCTATCTG (SEQ ID NO: 4415) | CCTACCTTGAATTCACCTATCTA (SEQ ID NO: 4416) | CATTTCCAAATCAGAAACATGA (SEQ ID NO: 4417) |
| hCV2195496 | C/T | GCACCTCACAAACACCG (SEQ ID NO: 4418) | TGCACCTCACAAACACCA (SEQ ID NO: 4419) | GCCTCTTCTGCAAATGGATGATATACAC (SEQ ID NO: 4420) |
| hCV2221541 | C/T | CCTGGAGTGGATGCCTTC (SEQ ID NO: 4421) | CCTGGAGTGGATGCCTTT (SEQ ID NO: 4422) | GGACAGCAGACACCTGAGC (SEQ ID NO: 4423) |
| hCV22271999 | C/T | GAGCACCTTAACTATAGATGGTG (SEQ ID NO: 4424) | TGAGCACCTTAACTATAGATGGTA (SEQ ID NO: 4425) | CTTGTCAAGGCACAGAATAATT (SEQ ID NO: 4426) |
| hCV22273354 | A/G | CAGGTCAGGCACAAACAT (SEQ ID NO: 4427) | CAGGTCAGGCACAAACAC (SEQ ID NO: 4428) | GAAGATGACCTGTTGAGTCAGTA (SEQ ID NO: 4429) |
| hCV22274594 | G/A | ACAACAGGAGCACACCG (SEQ ID NO: 4430) | GACAACAGGAGCACACCA (SEQ ID NO: 4431) | GATGCAGTCCCTTTTTCTAAA (SEQ ID NO: 4432) |
| hCV22274679 | C/T | TATCGCTGGGTAAACCG (SEQ ID NO: 4433) | GTATCGCTGGGTAAACCA (SEQ ID NO: 4434) | CGACTCTGAGGAGATGGAGTAT (SEQ ID NO: 4435) |
| hCV22274761 | A/G | ACTCCCCCAAGATCTTCT (SEQ ID NO: 4436) | CCCCCAAGATCTTCC (SEQ ID NO: 4437) | GCTCCCCCGACAAACT (SEQ ID NO: 4438) |
| hCV22275550 | C/T | CCATCTGTTCCGCCG (SEQ ID NO: 4439) | TCCATCTGTTCCGCCA (SEQ ID NO: 4440) | TTACCCAGCAGCGAAGAC (SEQ ID NO: 4441) |
| hCV22303 | A/G | AGCTTGGTTGTAGCCCA (SEQ ID NO: 4442) | GCTTGGTTGTAGCCCG (SEQ ID NO: 4443) | AGGCCAGCCTCCAAATCTTTC (SEQ ID NO: 4444) |
| hCV2230606 | A/G | AAATGTTGTCAACGTCCA (SEQ ID NO: 4445) | AATGTTGTCAACGTCCG (SEQ ID NO: 4446) | AGTCACTGGCAGCAATGAT (SEQ ID NO: 4447) |
| hCV2275263 | A/T | GTCCATCAGCAAATTGTCTCT (SEQ ID NO: 4448) | GTCCATCAGCAAATTGTCTCA (SEQ ID NO: 4449) | CCGATGACCTGGGGACATATTAG (SEQ ID NO: 4450) |
| hCV2275272 | C/T | CCTTTCCTTGTCTGTCTGC (SEQ ID NO: 4451) | CCTTTCCTTGTCTGTCTGT (SEQ ID NO: 4452) | GAAGGAGGGGAGGAATGACT (SEQ ID NO: 4453) |
| hCV2275273 | A/G | AGAGGTCAGCACTTACAGTT (SEQ ID NO: 4454) | AGAGGTCAGCACTTACAGTC (SEQ ID NO: 4455) | CAAGCAAGCATAGACCAGATAT (SEQ ID NO: 4456) |
| hCV2275276 | A/G | CCATTCACATACAAATCTTTCTTACT (SEQ ID NO: 4457) | CCATTCACATACAAATCTTTCTTACC (SEQ ID NO: 4450) | CCAGATGAAACTTCTTCCTGGTCATT (SEQ ID NO: 4459) |

TABLE 5-continued

| Marker | Alleles | Primer 1 (Allele-Specific Primer) | Primer 2 (Allele-Specific Primer) | Common Primer |
|---|---|---|---|---|
| hCV2276802 | A/C | TGGCTCAAGACCAAT (SEQ ID NO: 4460) | TGGCTCAAGACCAAG (SEQ ID NO: 4461) | CCCACATCCTTGCTGATC (SEQ ID NO: 4462) |
| hCV2310409 | A/T | CTCAGGGAGGGAGAGAGA (SEQ ID NO: 4463) | CTCAGGGAGGGAGAGAGT (SEQ ID NO: 4464) | ACAGCTCAGGCAGAAACTG (SEQ ID NO: 4465) |
| hCV2335281 | G/T | CAGCCTAGGCAGCATTG (SEQ ID NO: 4466) | CAGCCTAGGCAGCATTT (SEQ ID NO: 4467) | CCTGGGTTCAACCTTCTGAGTAGAT (SEQ ID NO: 4468) |
| hCV2485037 | A/G | TGCAAGAGGACTAAGCATGA (SEQ ID NO: 4469) | GCAAGAGGACTAAGCATGG (SEQ ID NO: 4470) | GCGGCCTTGCACTCA (SEQ ID NO: 4471) |
| hCV2503034 | A/C | ACGACAGGATCCTGAATGA (SEQ ID NO: 4472) | CGACAGGATCCTGAATGC (SEQ ID NO: 4473) | CCTAGCTCGTACCCACCTCT (SEQ ID NO: 4474) |
| hCV2531086 | A/G | GCCCCCCTCTCTGAAGA (SEQ ID NO: 4475) | CCCCCCTCTCTGAAGG (SEQ ID NO: 4476) | CCAGTTCGTGGTATGTTCATCT (SEQ ID NO: 4477) |
| hCV2531730 | T/A | CATTTGGCTATTTTAGCTCTAAA (SEQ ID NO: 4478) | ACATTTGGCTATTTTAGCTCTAAT (SEQ ID NO: 4479) | GCGGCTGGGTTTCTGT (SEQ ID NO: 4480) |
| hCV2536595 | A/G | CATCCCGCGCCAT (SEQ ID NO: 4481) | CATCCCGCGCCAC (SEQ ID NO: 4482) | CCTCCAGAGAAGAAGAAGACAC (SEQ ID NO: 4483) |
| hCV25472345 | C/T | GGTCACAGCCAGGC (SEQ ID NO: 4484) | AGGTCACAGCCAGGT (SEQ ID NO: 4485) | CCCCAGGAATATGTAAGTTGA (SEQ ID NO: 4486) |
| hCV25472673 | C/T | TGGGCTCCATCCCAC (SEQ ID NO: 4487) | TGGGCTCCATCCCAT (SEQ ID NO: 4488) | CCAATTCTTTTTCTTCTTTCAGTT (SEQ ID NO: 4489) |
| hCV25473098 | A/G | CACAGACTTGATGTTTTTGAAAGT (SEQ ID NO: 4490) | CAGACTTGATGTTTTTGAAAGC (SEQ ID NO: 4491) | TGCAAAGGAAGCAACTTCA (SEQ ID NO: 4492) |
| hCV25474101 | C/T | GCTGCTATTTTTGTTATTATTATTTTCTAC (SEQ ID NO: 4493) | GCTGCTATTTTTGTTATTATTATTTTCTAT (SEQ ID NO: 4494) | GGCCTTACCATCTCCAGAAA (SEQ ID NO: 4495) |
| hCV2553030 | C/T | CCGGCTTGCACTTCAC (SEQ ID NO: 4496) | CCGGCTTGCACTTCAT (SEQ ID NO: 4497) | CTTTGTGGCCGCAGTAGT (SEQ ID NO: 4498) |
| hCV2554615 | C/G | GCTCAGTCATTACCTTTGCC (SEQ ID NO: 4499) | GCTCAGTCATTACCTTTGCG (SEQ ID NO: 4500) | ACTGCTCCCTCCCATTCATACAG (SEQ ID NO: 4501) |
| hCV2554721 | A/G | TTAATTCTTTTGGCACAGGTAGA (SEQ ID NO: 4502) | ATTCTTTTGGCACAGGTAGG (SEQ ID NO: 4503) | TGACTGGGGAGAAGTGAGAACTAGA (SEQ ID NO: 4504) |
| hCV2557331 | C/T | GGGGCCATTTATTCTTCTTCAC (SEQ ID NO: 4505) | GGGGCCATTTATTCTTCTTCAT (SEQ ID NO: 4506) | GGAGTGGAAGGAATGGGGATTAAAG (SEQ ID NO: 4507) |
| hCV2557469 | A/C | TGCTGGTGGCTTTAAAGAA (SEQ ID NO: 4508) | TGCTGGTGGCTTTAAAGAC (SEQ ID NO: 4509) | GGCAAAACCCCTTTTATTG (SEQ ID NO: 4510) |
| hCV25591528 | A/G | TCCAAAAGGACCTGACAT (SEQ ID NO: 4511) | TCCAAAAGGACCTGACAC (SEQ ID NO: 4512) | GGCTGCAGAATGGAATTT (SEQ ID NO: 4513) |
| hCV25596880 | C/G | CCTAGACAATAAAGATGGTCCTC (SEQ ID NO: 4514) | CCTAGACAATAAAGATGGTCCTG (SEQ ID NO: 4515) | CCAACTCTCTTCCTCTTGTCAT (SEQ ID NO: 4516) |
| hCV25598594 | A/G | ATATATTGACCGTTCTCCCAT (SEQ ID NO: 4517) | ATATATTGACCGTTCTCCCAC (SEQ ID NO: 4518) | GCCACCTCCAACCATATC (SEQ ID NO: 4519) |
| hCV25603879 | C/T | GAAGTCATTCTGCTCTGC (SEQ ID NO: 4520) | ATGAAGTCATTCTGCTCTGT (SEQ ID NO: 4521) | TTTCCATCTCCTAACTCTTTTCTAG (SEQ ID NO: 4522) |
| hCV25605897 | G/T | AAGGCAGGATGGGAGTG (SEQ ID NO: 4523) | AAAGGCAGGATGGGAGTT (SEQ ID NO: 4524) | CGTCAAAGCACTAATGTCATGT (SEQ ID NO: 4525) |
| hCV25607193 | C/T | GCGCAAAAGGCAAGAC (SEQ ID NO: 4526) | GCGCAAAAGGCAAGAT (SEQ ID NO: 4527) | CCTTGGGACACACATTTACAG (SEQ ID NO: 4528) |
| hCV25608818 | A/G | CTCAATGTCGTATTCACCTTCT (SEQ ID NO: 4529) | CAATGTCGTATTCACCTTCC (SEQ ID NO: 4530) | ACTCCAGGATTTTTCAAAGATTAT (SEQ ID NO: 4531) |
| hCV25609975 | A/C | CTTTGAACCTTTTCACCACA (SEQ ID NO: 4532) | TTTGAACCTTTTCACCACC (SEQ ID NO: 4533) | GAGTGAGGAGGGAGAAAGTAAG (SEQ ID NO: 4534) |

TABLE 5-continued

| Marker | Alleles | Primer 1 (Allele-Specific Primer) | Primer 2 (Allele-Specific Primer) | Common Primer |
|---|---|---|---|---|
| hCV25610470 | A/G | CACAATCACCACGGTCT (SEQ ID NO: 4535) | ACAATCACCACGGTCC (SEQ ID NO: 4536) | CCTTCTGCATCAGCATCTTC (SEQ ID NO: 4537) |
| hCV25610774 | C/T | GGGTCGGTGCAAGAGG (SEQ ID NO: 4538) | GGGTCGGTGCAAGAGA (SEQ ID NO: 4539) | GCACCTTGGTGGGTTTGT (SEQ ID NO: 4540) |
| hCV25610819 | A/T | GGACGTGGACATGGAGT (SEQ ID NO: 4541) | GGACGTGGACATGGAGA (SEQ ID NO: 4542) | CGGCGCTCGTAGGTG (SEQ ID NO: 4543) |
| hCV25614016 | A/G | AGTGGCCAAGAACACCA (SEQ ID NO: 4544) | TGGCCAAGAACACCG (SEQ ID NO: 4545) | GGTATGAGGCAAAGTTCCTG (SEQ ID NO: 4546) |
| hCV25617571 | C/T | CCAGCAGTATGGACG (SEQ ID NO: 4547) | TGCCAGCAGTATGGACA (SEQ ID NO: 4548) | CCATCCAGCCTCAGGAAC (SEQ ID NO: 4549) |
| hCV25618493 | G/A | GAGGCTGCGTATCC (SEQ ID NO: 4550) | GGAGGCTGCGTATCT (SEQ ID NO: 4551) | GTAGCTGTGCAGTGACAGTGT (SEQ ID NO: 4552) |
| hCV25623265 | A/G | TGGAGGCTGATGGGTA (SEQ ID NO: 4553) | GGAGGCTGATGGGTG (SEQ ID NO: 4554) | CGCTTTGCAGCCATAACT (SEQ ID NO: 4555) |
| hCV25629396 | C/G | AGAACGCCTATGAGGAGTG (SEQ ID NO: 4556) | AAGAACGCCTATGAGGAGTC (SEQ ID NO: 4557) | TTGGGTGGCACCATATG (SEQ ID NO: 4558) |
| hCV25629476 | A/G | ATCTCCTCGGCTGTCTT (SEQ ID NO: 4559) | ATCTCCTCGGCTGTCTC (SEQ ID NO: 4560) | AACCTCACCTGGCATGAG (SEQ ID NO: 4561) |
| hCV25629492 | A/G | CCCACAGCCTGCGAT (SEQ ID NO: 4562) | CCCACAGCCTGCGAC (SEQ ID NO: 4563) | CCGCTTGAGGTCCACATA (SEQ ID NO: 4564) |
| hCV25629888 | C/G | GCACCTTGCTGCTGTCTG (SEQ ID NO: 4565) | GCACCTTGCTGCTGTCTC (SEQ ID NO: 4566) | GCCCTGATCACTGCAAAAC (SEQ ID NO: 4567) |
| hCV25630686 | C/T | AGGTTGTACCTGTAGCACTAAGAC (SEQ ID NO: 4568) | TAGGTTGTACCTGTAGCACTAAGAT (SEQ ID NO: 4569) | TGGGCTCCTCAGAGAAAATAT (SEQ ID NO: 4570) |
| hCV25631989 | C/T | AAGATAAGCCTGTCACTGGTC (SEQ ID NO: 4571) | AAGATAAGCCTGTCACTGGTT (SEQ ID NO: 4572) | CAAGCCAGCCTAATAAACATAA (SEQ ID NO: 4573) |
| hCV25636622 | C/T | TCTGTAGTCAACAGGAGAAGAGAC (SEQ ID NO: 4574) | TCTGTAGTCAACAGGAGAAGAGAT (SEQ ID NO: 4575) | GCTGGGTTTTGGTGAAGTT (SEQ ID NO: 4576) |
| hCV25637309 | A/T | GGCCACTTTGCCTGAATA (SEQ ID NO: 4577) | GGCCACTTTGCCTGAATT (SEQ ID NO: 4578) | CGAAATGTTCATTTTAAAGTCAGA (SEQ ID NO: 4579) |
| hCV25640504 | C/T | CCAAGATCTTCAGCAACG (SEQ ID NO: 4580) | ACCAAGATCTTCAGCAACA (SEQ ID NO: 4581) | TGCAACCTCCACACAATCT (SEQ ID NO: 4582) |
| hCV25640504 | C/T | CTAAGGTCTTCAGCAATG (SEQ ID NO: 5415) | CTAAGGTCTTCAGCAATA (SEQ ID NO: 5416) | TGCAACCTCCACACAATCT (SEQ ID NO: 4582) |
| hCV25642473 | C/T | CCACATAGATTCCTAAGAACG (SEQ ID NO: 4583) | ACCACATAGATTCCTAAGAACA (SEQ ID NO: 4584) | CAAACACCATGGTTTTCTTT (SEQ ID NO: 4585) |
| hCV25643756 | C/T | CACTGCCATGCTCG (SEQ ID NO: 4586) | ACACTGCCATGCTCA (SEQ ID NO: 4587) | GCTGGCGCAGGAAGTAG (SEQ ID NO: 4588) |
| hCV25644901 | A/G | CAGACCTGCAGCTTCA (SEQ ID NO: 4589) | AGACCTGCAGCTTCG (SEQ ID NO: 4590) | TGTAACCCATCAACTCTGTTTATC (SEQ ID NO: 4591) |
| hCV25651076 | A/G | GATGCTGGCAAAGAACA (SEQ ID NO: 4592) | ATGCTGGCAAAGAACG (SEQ ID NO: 4593) | CAATCATCCACCTTTGTCTGT (SEQ ID NO: 4594) |
| hCV25651174 | A/G | CGCTGCAGGGTCAT (SEQ ID NO: 4595) | CGCTGCAGGGTCAC (SEQ ID NO: 4596) | CCTCCCCGCAGAGAATTA (SEQ ID NO: 4597) |
| hCV25652744 | C/A | AATGGTCCAGTTCCCTCTC (SEQ ID NO: 4598) | CAATGGTCCAGTTCCCTCTA (SEQ ID NO: 4599) | TGAAGTGTGAATGATGCTGATA (SEQ ID NO: 4600) |
| hCV25742059 | A/G | CTGCCTCTTCTGCATTAGA (SEQ ID NO: 4601) | TGCCTCTTCTGCATTAGG (SEQ ID NO: 4602) | CCTTCACTGCCTGTTTCTCT (SEQ ID NO: 4603) |
| hCV25745415 | G/T | TGACAGAGAATACTGGAAGATATG (SEQ ID NO: 4604) | CTGACAGAGAATACTGGAAGATATT (SEQ ID NO: 4605) | CCATCTTGGCCATGTTTAAT (SEQ ID NO: 4606) |
| hCV25749177 | G/A | CAGTGCTGGAACCTGTAAGTC (SEQ ID NO: 4607) | CAGTGCTGGAACCTGTAAGTT (SEQ ID NO: 4608) | TGGAGTCAAAGGTTAAAACTCA (SEQ ID NO: 4609) |

TABLE 5-continued

| Marker | Alleles | Primer 1 (Allele-Specific Primer) | Primer 2 (Allele-Specific Primer) | Common Primer |
|---|---|---|---|---|
| hCV25753038 | T/C | GGAGCCACCTATGTTCTCTACT (SEQ ID NO: 4610) | GAGCCACCTATGTTCTCTACC (SEQ ID NO: 4611) | TCCCTCTTTGCTCATTCATC (SEQ ID NO: 4612) |
| hCV25767229 | C/T | GTGTGGCAATGAAGTCCC (SEQ ID NO: 4613) | AGTGTGGCAATGAAGTCCT (SEQ ID NO: 4614) | GCAGTGCTCGTTACATGAAAGATC (SEQ ID NO: 4615) |
| hCV25767417 | A/G | AGCCCCTTGTCTTCCAT (SEQ ID NO: 4616) | AGCCCCTTGTCTTCCAC (SEQ ID NO: 4617) | AAAGCAGTTCGACAAAATCTTA (SEQ ID NO: 4618) |
| hCV25770061 | A/C | CCAAGCGACAGTCATAGTCT (SEQ ID NO: 4619) | CAAGCGACAGTCATAGTCG (SEQ ID NO: 4620) | GTGCTGAATGTTTGCTCTGTGTATCTAC (SEQ ID NO: 4621) |
| hCV25922320 | A/G | CTCGCAGCGGTCAGT (SEQ ID NO: 4622) | TCGCAGCGGTCAGC (SEQ ID NO: 4623) | GCTGGCGGGAATTTCT (SEQ ID NO: 4624) |
| hCV25922440 | C/T | CGAACTCTTCAAGGTGGTTG (SEQ ID NO: 4625) | CCGAACTCTTCAAGGTGGTTA (SEQ ID NO: 4626) | CCATGCATGCTTCAGGTAAG (SEQ ID NO: 4627) |
| hCV25922816 | A/G | TGGCACTCAGGGCAT (SEQ ID NO: 4628) | TGGCACTCAGGGCAC (SEQ ID NO: 4629) | CCAAAGAGGACTGACAACTGTA (SEQ ID NO: 4630) |
| hCV25924894 | A/G | GGGAAGTTCTTTCTTGTATATTCAA (SEQ ID NO: 4631) | GGGAAGTTCTTTCTTGTATATTCAG (SEQ ID NO: 4632) | TGCTGTCTTTGCCTCACTAAT (SEQ ID NO: 4633) |
| hCV25925481 | A/G | AATCAGCATTTTTGTCAAAGA (SEQ ID NO: 4634) | ATCAGCATTTTTGTCAAAGG (SEQ ID NO: 4635) | GGCTTGTGACCTCATTGTTT (SEQ ID NO: 4636) |
| hCV25925974 | G/C | AAAGCAAAGGCACAGAGAG (SEQ ID NO: 4637) | AAAGCAAAGGCACAGAGAC (SEQ ID NO: 4638) | TGCCGTGCTGAGTTAATG (SEQ ID NO: 4639) |
| hCV25926178 | C/G | GCTTTATCAGAGACTCTGAAGC (SEQ ID NO: 4640) | GCTTTATCAGAGACTCTGAAGG (SEQ ID NO: 4641) | CCAAGGCCACGGATATC (SEQ ID NO: 4642) |
| hCV2592654 | A/C | CAGTAAGCTGGAGAGTGGA (SEQ ID NO: 4643) | AGTAAGCTGGAGAGTGGC (SEQ ID NO: 4644) | TGGGAGGTGGATAAGGCAGATAAG (SEQ ID NO: 4645) |
| hCV2592662 | A/G | GTTTGTGGGTTTTGTGGGA (SEQ ID NO: 4646) | TTTGTGGGTTTTGTGGGG (SEQ ID NO: 4647) | CAGAGCAGCTTTCAAACTTTCTGAA (SEQ ID NO: 4648) |
| hCV25926643 | G/A | CCTGGTTAGCTTTACCTTACG (SEQ ID NO: 4649) | CCCTGGTTAGCTTTACCTTACA (SEQ ID NO: 4650) | CCCTTGCCATCCACACT (SEQ ID NO: 4651) |
| hCV25926771 | C/T | GGCCTTGGTCTCGC (SEQ ID NO: 4652) | TGGCCTTGGTCTCGT (SEQ ID NO: 4653) | TGCAGATCAGCTTGAAGAACTA (SEQ ID NO: 4654) |
| hCV2592715 | A/T | CTGACCTTTCCTTTATTAAGCATCTATA (SEQ ID NO: 4655) | TGACCTTTCCTTTATTAAGCATCTATT (SEQ ID NO: 4656) | GTGCCGCTGTTTCCTCATGT (SEQ ID NO: 4657) |
| hCV25927459 | G/T | GGCTGTTGCTCCTCTTATG (SEQ ID NO: 4658) | TGGCTGTTGCTCCTCTTATT (SEQ ID NO: 4659) | GGACCTGTCAATCTTGGTCATCTAT (SEQ ID NO: 4660) |
| hCV2592759 | A/C | TCCTCTCAGATAGTGTGAATACAATA (SEQ ID NO: 4661) | CCTCTCAGATAGTGTGAATACAATC (SEQ ID NO: 4662) | CAACTGAGGCAAATACTGTGCTAACT (SEQ ID NO: 4663) |
| hCV25928135 | C/T | TTTCACCGTATTAGCCAGG (SEQ ID NO: 4664) | GTTTCACCGTATTAGCCAGA (SEQ ID NO: 4665) | CCCATAGTGGCCTCAATAGT (SEQ ID NO: 4666) |
| hCV25928538 | C/G | TCCACTGTTTTGAACGC (SEQ ID NO: 4667) | TCCACTGTTTTTGAACGG (SEQ ID NO: 4668) | TAATTGCAAGAATATTGAAAGACA (SEQ ID NO: 4669) |
| hCV25930271 | C/T | GAATCTCATGTTCAGGAAATG (SEQ ID NO: 4670) | CGAATCTCATGTTCAGGAAATA (SEQ ID NO: 4671) | GCCATGCCCATAAAAC (SEQ ID NO: 4672) |
| hCV25932224 | T/G | AGCCACTAAGCTCAAACTCTTT (SEQ ID NO: 4673) | GCCACTAAGCTCAAACTCTTG (SEQ ID NO: 4674) | CCCTAAAACCAAAGACGTATGT (SEQ ID NO: 4675) |
| hCV25941408 | G/T | CATGGAGTCAACTCTTGAGG (SEQ ID NO: 4676) | GCATGGAGTCAACTCTTGAGT (SEQ ID NO: 4677) | GGCTGTGCTTTGTCTGATCT (SEQ ID NO: 4678) |
| hCV25942539 | G/A | GGATCCGACCGTTGAG (SEQ ID NO: 4679) | GGATCCGACCGTTGAA (SEQ ID NO: 4680) | TCATTTTGAACTCATTTTTTCTAGA (SEQ ID NO: 4681) |
| hCV25943180 | T/C | GGTGGTCTTCCAGTCCTT (SEQ ID NO: 4682) | GGTGGTCTTCCAGTCCTC (SEQ ID NO: 4683) | TTGCTCCCTGCGAGTAAG (SEQ ID NO: 4684) |

TABLE 5-continued

| Marker | Alleles | Primer 1 (Allele-Specific Primer) | Primer 2 (Allele-Specific Primer) | Common Primer |
|---|---|---|---|---|
| hCV25965660 | A/G | GGCCTGGTGGAAGTGAT (SEQ ID NO: 4685) | GGCCTGGTGGAAGTGAC (SEQ ID NO: 4686) | AGTGTCAAGGTAATCTGGTTTTT (SEQ ID NO: 4687) |
| hCV25972680 | A/G | GCAGGCCTTTCTCAGAAT (SEQ ID NO: 4688) | GCAGGCCTTTCTCAGAAC (SEQ ID NO: 4689) | CAGGAAGAGAAGAAGTCACTTGT (SEQ ID NO: 4690) |
| hCV25996298 | G/T | CAGAGGCTGCTCCGC (SEQ ID NO: 4691) | ACAGAGGCTGCTCCGA (SEQ ID NO: 4692) | GGGTTTGTGGGCTCTTC (SEQ ID NO: 4693) |
| hCV26000635 | C/A | TGCTGGAGCAATTGAGAG (SEQ ID NO: 4694) | CTGCTGGAGCAATTGAGAT (SEQ ID NO: 4695) | TCTTCCCCTCGTTTCTTTC (SEQ ID NO: 4696) |
| hCV260164 | G/T | ACAGGTCACTGGGATTGG (SEQ ID NO: 4697) | ACAGGTCACTGGGATTGT (SEQ ID NO: 4698) | CTGGACAGTGTTTGGAAGGTCATA (SEQ ID NO: 4699) |
| hCV2604332 | G/T | GCAAATCAAGTAAAAGATCTGTTTC (SEQ ID NO: 4700) | GCAAATCAAGTAAAAGATCTGTTTA (SEQ ID NO: 4701) | CTGCAGCAGCTAAATGTCA (SEQ ID NO: 4702) |
| hCV26294850 | C/T | GCCCAAGCGGAAGGTACGACTTTCCGGCTGAAAGCCG (SEQ ID NO: 4703) | GCATACCTTGCCAGTAGCGATGCGGCGGCTGAAAGCCA (SEQ ID NO: 4704) | GCAGCACGAACTGC (SEQ ID NO: 4705) |
| hCV2632070 | A/G | GACTAAAGTTCTGAGCCAATCAA (SEQ ID NO: 4706) | ACTAAAGTTCTGAGCCAATCAG (SEQ ID NO: 4707) | GCCCTTTGTTCCTCGGTTTAGAG (SEQ ID NO: 4708) |
| hCV2632498 | C/G | CAATTGAGGTCCAGGAGC (SEQ ID NO: 4709) | CAATTGAGGTCCAGGAGG (SEQ ID NO: 4710) | TGGTGCAAACAGCTCTTCT (SEQ ID NO: 4711) |
| hCV2632544 | C/T | ACTGACCCTTCACACATTTAC (SEQ ID NO: 4712) | GTAACTGACCCTTCACACATTTAT (SEQ ID NO: 4713) | TGAGCCATCGTGCCTAGCTA (SEQ ID NO: 4714) |
| hCV2633049 | G/T | CTTCTAGGCTCTGTGGTCC (SEQ ID NO: 4715) | CTTCTAGGCTCTGTGGTCA (SEQ ID NO: 4716) | CCACGTGCCCATGAAG (SEQ ID NO: 4717) |
| hCV2658421 | A/C | CTCTCTTTCAGCATCTTGTAAAT (SEQ ID NO: 4718) | CTCTCTTTCAGCATCTTGTAAAG (SEQ ID NO: 4719) | TGCAGAAGAAAGAAACTTTATCAC (SEQ ID NO: 4720) |
| hCV26660340 | C/G | TGTGTCCAAAGGGACCAC (SEQ ID NO: 4721) | TGTGTCCAAAGGGACCAG (SEQ ID NO: 4722) | GACCCCATTTTCCTGGACCATTAAG (SEQ ID NO: 4723) |
| hCV26683367 | C/G | CCTATTAAGATGAGAACCTCAACAC (SEQ ID NO: 4724) | CCTATTAAGATGAGAACCTCAACAG (SEQ ID NO: 4725) | GGAGGTGGAAGAGCATTGAAACT (SEQ ID NO: 4726) |
| hCV26683368 | C/T | TGTAAAATGCCTGTCACGG (SEQ ID NO: 4727) | GTGTAAAATGCCTGTCACGA (SEQ ID NO: 4728) | CGATGACATTCTTGGTCTGTACACT (SEQ ID NO: 4729) |
| hCV2680532 | A/C | GGGCCTCACCTTGGT (SEQ ID NO: 4730) | GGGCCTCACCTTGGG (SEQ ID NO: 4731) | GCCTCCCCAGATTGATGTCT (SEQ ID NO: 4732) |
| hCV26809148 | A/G | CATCATGGTGTTCTTGCCT (SEQ ID NO: 4733) | ATCATGGTGTTCTTGCCC (SEQ ID NO: 4734) | CATTATCTGAAATGTTTCATTGTAGA (SEQ ID NO: 4735) |
| hCV26898946 | C/T | TGGGTGGCAGTCCC (SEQ ID NO: 4736) | GTGGGTGGCAGTCCT (SEQ ID NO: 4737) | GGGGACAGGTATGCATGTCAT (SEQ ID NO: 4738) |
| hCV27157435 | C/T | GGAACTTAATTGCTTGATACTATCAC (SEQ ID NO: 4739) | GGAACTTAATTGCTTGATACTATCAT (SEQ ID NO: 4740) | GACACCACCGTCCTACACTG (SEQ ID NO: 4741) |
| hCV27157439 | A/C | GTAACTAACACTCAGAAGTACATTTT (SEQ ID NO: 4742) | GTAACTAACACTCAGAAGTACATTTG (SEQ ID NO: 4743) | GTTGAGGCTGCAGTGAGCTATAAT (SEQ ID NO: 4744) |
| hCV2741051 | C/T | GCAGCCAGTTTCTCCC (SEQ ID NO: 4745) | TGCAGCCAGTTTCTCCT (SEQ ID NO: 4746) | CATGAAATGCTTCCAGGTATT (SEQ ID NO: 4747) |
| hCV2741083 | C/T | GTTCCAACCAGAAGAGAATG (SEQ ID NO: 4748) | GGTTCCAACCAGAAGAGAATA (SEQ ID NO: 4749) | CTTGCCCCAACAGTTAG (SEQ ID NO: 4750) |
| hCV27422538 | C/G | GCAATCTCTCCTTCCTCTCC (SEQ ID NO: 4751) | GCAATCTCTCCTTCCTCTCG (SEQ ID NO: 4752) | ACACACACACCTCCACAAATACTAA (SEQ ID NO: 4753) |
| hCV27457080 | C/T | AAATAGGTCGTTCTGACATAAAAG (SEQ ID NO: 4754) | AAATAGGTCGTTCTGACATAAAAA (SEQ ID NO: 4755) | CCCACTCCACCATCTGTATAG (SEQ ID NO: 4756) |
| hCV27462774 | A/G | AAGATCATGATTTATCTTGGTTCCTA (SEQ ID NO: 4757) | AGATCATGATTTATCTTGGTTCCTG (SEQ ID NO: 4758) | GGTGGTCAGCACATGACTTCT (SEQ ID NO: 4759) |

TABLE 5-continued

| Marker | Alleles | Primer 1 (Allele-Specific Primer) | Primer 2 (Allele-Specific Primer) | Common Primer |
|---|---|---|---|---|
| hCV27480853 | C/T | CCTGTTAGGTGTGTTGCTTTAAC (SEQ ID NO: 4760) | CCTGTTAGGTGTGTTGCTTTAAT (SEQ ID NO: 4761) | GCTTACGCCATTTTCTGTCGGTATTT (SEQ ID NO: 4762) |
| hCV2762168 | C/T | CCCCATGGTTTGTTGTTGC (SEQ ID NO: 4763) | CCCCATGGTTTGTTGTTGT (SEQ ID NO: 4764) | CGACTTCAGTGACCACACATAACA (SEQ ID NO: 4765) |
| hCV2769554 | A/G | TCCGTTGTTCTCAGGGAT (SEQ ID NO: 4766) | TCCGTTGTTCTCAGGGAC (SEQ ID NO: 4767) | GGTTCCTGGAGGCATGTC (SEQ ID NO: 4768) |
| hCV2781953 | G/T | ACATTGCGGTTATTGCTAGTG (SEQ ID NO: 4769) | ACATTGCGGTTATTGCTAGTT (SEQ ID NO: 4770) | CACCTGCCTCTCAAAGAATAGC (SEQ ID NO: 4771) |
| hCV27884601 | C/T | GGAATATTTGGGTTTGTTTCACC (SEQ ID NO: 4772) | GGAATATTTGGGTTTGTTTCACT (SEQ ID NO: 4773) | CTGGGACTGTCTATTTTCTTTCATTCAACC (SEQ ID NO: 4774) |
| hCV27958354 | C/T | GCTATGAGGAGAACACAAGAATATAC (SEQ ID NO: 4775) | GCTATGAGGAGAACACAAGAATATAT (SEQ ID NO: 4776) | CATTCCCTCTGCCCCTTCTTAGATA (SEQ ID NO: 4777) |
| hCV27970553 | C/T | ACCTAAACTTTGGTATCACCG (SEQ ID NO: 4778) | CACCTAAACTTTGGTATCACCA (SEQ ID NO: 4779) | CTCACCCGCTGATATTTGTTTAACCT (SEQ ID NO: 4780) |
| hCV28008078 | C/T | CTGTCACAAGCAACAGAAAG (SEQ ID NO: 4781) | TCTGTCACAAGCAACAGAAAA (SEQ ID NO: 4782) | CGAGGAGGAGATAACTGGATGTGT (SEQ ID NO: 4783) |
| hCV28023091 | C/T | TTCAGTTCTTTGCAGTAATAAACAG (SEQ ID NO: 4784) | TTCAGTTCTTTGCAGTAATAAACAA (SEQ ID NO: 4785) | CATTTGTCTGAGGGTTCACTTGTTGA (SEQ ID NO: 4786) |
| hCV2822674 | A/G | GATGCTGGGTGGATGTT (SEQ ID NO: 4787) | GATGCTGGGTGGATGTC (SEQ ID NO: 4788) | TGTGGCCCTGAGAATGTAC (SEQ ID NO: 4789) |
| hCV282793 | C/T | ATCTATTCACAAACACATGAACAAG (SEQ ID NO: 4790) | ATCTATTCACAAACACATGAACAAA (SEQ ID NO: 4791) | GAGACACCCAAGCAAACTGAACTTAC (SEQ ID NO: 4792) |
| hCV2829795 | A/G | GTTTCTCTCCAGTATGAATTCTTT (SEQ ID NO: 4793) | GTTTCTCTCCAGTATGAATTCTTC (SEQ ID NO: 4794) | AATTCATTCTGGAGAGAAATCTTAC (SEQ ID NO: 4795) |
| hCV28960526 | A/T | TGAAGGCACCTGTCATCAT (SEQ ID NO: 4796) | TGAAGGCACCTGTCATCAA (SEQ ID NO: 4797) | CTCCTGGTGGGCCTTTTGAAATA (SEQ ID NO: 4798) |
| hCV28974083 | A/G | TTCACTTCAAGCTTCCATAGTTAT (SEQ ID NO: 4799) | TCACTTCAAGCTTCCATAGTTAC (SEQ ID NO: 4800) | CCTCCTCTTCTCATCAATCCCAAATT-AGT (SEQ ID NO: 4801) |
| hCV28993059 | A/G | GAATGAGTAAGGGAAGAGGAAAA (SEQ ID NO: 4802) | GAATGAGTAAGGGAAGAGGAAAG (SEQ ID NO: 4803) | GCTGAATTGTCTGACGGAATCT (SEQ ID NO: 4804) |
| hCV29011391 | A/G | GCTCGGAAAAGCCAAGAAA (SEQ ID NO: 4805) | GCTCGGAAAAGCCAAGAAG (SEQ ID NO: 4806) | GATCCAGATTTTGTCAAAGCCACTAGA (SEQ ID NO: 4807) |
| hCV29033518 | A/T | GCATTATACATGTGCAGTCACATT (SEQ ID NO: 4808) | GCATTATACATGTGCAGTCACATA (SEQ ID NO: 4809) | CCACCATGGCTGTGTCTTGT (SEQ ID NO: 4810) |
| hCV29135108 | A/C | GGAGTGCTTTTATGGCAAAA (SEQ ID NO: 4811) | GGAGTGCTTTTATGGCAAAC (SEQ ID NO: 4812) | GCTGATAGTGCAAGTTAGCAACATAGT (SEQ ID NO: 4813) |
| hCV29195255 | A/C | TCCAGCAATTCCACTTCCA (SEQ ID NO: 4814) | CCAGCAATTCCACTTCCC (SEQ ID NO: 4815) | AGAACTAGCAAAGCACCTCTGTAGAA (SEQ ID NO: 4816) |
| hCV29195260 | A/G | CATTATCTAGTTTCTTTACTTGTCTTCT (SEQ ID NO: 4817) | CATTATCTAGTTTCTTTACTTGTCTTCC (SEQ ID NO: 4818) | AGCATCTTCTGTGTCCAGCTAAGT (SEQ ID NO: 4819) |
| hCV2932115 | C/T | TGGACGTGGGCTTTTTC (SEQ ID NO: 4820) | TGGACGTGGGCTTTTTT (SEQ ID NO: 4821) | GCTGCAGCCCTTTTTCTC (SEQ ID NO: 4822) |
| hCV29322781 | A/G | AGATATCCACTACTCTTCTTCTCAA (SEQ ID NO: 4823) | AGATATCCACTACTCTTCTTCTCAG (SEQ ID NO: 4824) | CTTAAGCCAGTCCTGCACAACTAG (SEQ ID NO: 4825) |
| hCV29368919 | C/T | GCTTCAAGAGGATAAAGTAAAACAGAG (SEQ ID NO: 4826) | GCTTCAAGAGGATAAAGTAAAACAGAA (SEQ ID NO: 4827) | GATATAACCTGTCACTACACTGGACTGAA (SEQ ID NO: 4828) |
| hCV29480044 | C/T | GGTGGGCCTTTTGAAATAAAC (SEQ ID NO: 4829) | TGGTGGGCCTTTTGAAATAAAT (SEQ ID NO: 4830) | CTTGAAGTGAAGGCACCTGTCAT (SEQ ID NO: 4831) |

TABLE 5-continued

| Marker | Alleles | Primer 1 (Allele-Specific Primer) | Primer 2 (Allele-Specific Primer) | Common Primer |
|---|---|---|---|---|
| hCV2948766 | A/G | ACAATAACCCTTCTAATTGCACA (SEQ ID NO: 4832) | CAATAACCCTTCTAATTGCACG (SEQ ID NO: 4833) | GTGTTGCTGAAATCATGGAGTCTGAT (SEQ ID NO: 4834) |
| hCV2960489 | A/G | CCCACCATCCACTTCCT (SEQ ID NO: 4835) | CCCACCATCCACTTCCC (SEQ ID NO: 4836) | CTCCAGCGTTGGGGATGATG (SEQ ID NO: 4837) |
| hCV2966448 | A/G | GTTAAACCTTCTTTATCTCCTCCTT (SEQ ID NO: 4838) | GTTAAACCTTCTTTATCTCCTCCTC (SEQ ID NO: 4839) | CGCTTCGCCTTGGGATATG (SEQ ID NO: 4840) |
| hCV29684678 | C/G | CAGCTACACTTCAGTCTACTTAG (SEQ ID NO: 4841) | CAGCTACACTTCAGTCTACTTAC (SEQ ID NO: 4842) | GAGAAGGAGACTGGAGACAGATATGAC (SEQ ID NO: 4843) |
| hCV29809835 | A/C | GTCTCGGAAGCAATGTTCTA (SEQ ID NO: 4844) | TCTCGGAAGCAATGTTCTC (SEQ ID NO: 4845) | GCTTCTGCCACCCCTGTAAAT (SEQ ID NO: 4846) |
| hCV29819064 | C/T | TCGCTTTGAAACACTCTGC (SEQ ID NO: 4847) | CTCGCTTTGAAACACTCTGT (SEQ ID NO: 4848) | CTGTGGCTTCAGGCTTTACAGT (SEQ ID NO: 4849) |
| hCV2983035 | A/G | TTGGACCCTCACATGAAA (SEQ ID NO: 4850) | TTGGACCCTCACATGAAG (SEQ ID NO: 4851) | GCCATTTTCCACAATAAATATTT (SEQ ID NO: 4852) |
| hCV2983036 | C/G | GCTGACTTTTTGCTCTTTC (SEQ ID NO: 4853) | GCTGACTTTTTGCTCTTTG (SEQ ID NO: 4854) | GCCATTTTCCACAATAAATATTT (SEQ ID NO: 4855) |
| hCV2987229 | C/T | GGAGGGAGGCAACCAC (SEQ ID NO: 4856) | GGAGGGAGGCAACCAT (SEQ ID NO: 4857) | TGCCCGATAAACGTGAGGTAGAA (SEQ ID NO: 4858) |
| hCV2987250 | C/G | ACTGCTCCAAGATAGAGGTAC (SEQ ID NO: 4859) | ACTGCTCCAAGATAGAGGTAG (SEQ ID NO: 4860) | CAGCATTTGTGAGAGGAGCTGTTT (SEQ ID NO: 4861) |
| hCV29873524 | C/T | TCATCAAACCACTCAAGCTAC (SEQ ID NO: 4862) | TTTCATCAAACCACTCAAGCTAT (SEQ ID NO: 4863) | CACTCAAATGGAAGAGTCATTGGTGAAT (SEQ ID NO: 4864) |
| hCV2992252 | T/C | CCCTGTGATTGGCCAT (SEQ ID NO: 4865) | CCCTGTGATTGGCCAC (SEQ ID NO: 4866) | CCTGCTCGCTCTGTCAC (SEQ ID NO: 4867) |
| hCV29945430 | G/T | GAGCTCATGTGCATTATAAACG (SEQ ID NO: 4868) | AGAGCTCATGTGCATTATAAACT (SEQ ID NO: 4869) | CCGCCTACTGACTACCTGTCTA (SEQ ID NO: 4870) |
| hCV29952522 | A/G | ACTGGAAAGATGACACATCTACA (SEQ ID NO: 4871) | CTGGAAAGATGACACATCTACG (SEQ ID NO: 4872) | GGGCTACACCCAAAGGCTAAATC (SEQ ID NO: 4873) |
| hCV30136303 | C/G | TCACCCCACTCTGCTATAG (SEQ ID NO: 4874) | TCACCCCACTCTGCTATAC (SEQ ID NO: 4875) | CAAAGGCTGGGAAGGGTATGTATATTG (SEQ ID NO: 4876) |
| hCV30233466 | A/G | GCGCCCGGATGGAAT (SEQ ID NO: 4877) | GCGCCCGGATGGAAC (SEQ ID NO: 4878) | ACGCCCACTCCAGTTACTAAACA (SEQ ID NO: 4879) |
| hCV3026189 | C/T | CTTCTTGCCCTTCAGCTC (SEQ ID NO: 4880) | CTTCTTGCCCTTCAGCTT (SEQ ID NO: 4881) | CCCAGTTCTGAGATGTGTATGT (SEQ ID NO: 4882) |
| hCV30264691 | G/T | TTCTCCTGAAGAATTGTAAGCC (SEQ ID NO: 4883) | TTTCTCCTGAAGAATTGTAAGCA (SEQ ID NO: 4884) | GAAGTTAGCCAATCTTGTCATCTTTTCACT (SEQ ID NO: 4885) |
| hCV30287627 | A/T | AATGCAAAATGCAAACTGTCTAA (SEQ ID NO: 4886) | CAATGCAAAATGCAAACTGTCTAT (SEQ ID NO: 4887) | TGGAGTTGTCGTCCTGTGGATAAT (SEQ ID NO: 4888) |
| hCV30454150 | C/T | TCTAGCAGATTTGTATCAGAACC (SEQ ID NO: 4889) | TAATCTAGCAGATTTGTATCAGAACT (SEQ ID NO: 4890) | GCGACCCTCTCTGGTTAAACA (SEQ ID NO: 4891) |
| hCV30467730 | C/T | CTCTACTGTTTAGAATCGTTTTCAAC (SEQ ID NO: 4892) | CTCTACTGTTTAGAATCGTTTTCAAT (SEQ ID NO: 4893) | CCAGCGGTAATTGGAGCAATCTTA (SEQ ID NO: 4894) |
| hCV30534667 | A/G | AGAACAACTCAAAGGTGCAAA (SEQ ID NO: 4895) | AGAACAACTCAAAGGTGCAAG (SEQ ID NO: 4896) | ACATGACCTGTTCTAACTGGGAGTTATG (SEQ ID NO: 4897) |
| hCV30574599 | C/T | CCATGCACACTTTAATGTGTAC (SEQ ID NO: 4898) | TCCATGCACACTTTAATGTGTAT (SEQ ID NO: 4899) | CCCAAACACAACAGGCTAGAACAAAT (SEQ ID NO: 4900) |
| hCV30586985 | A/G | TCGGTGATTGGTACAAGAGTAA (SEQ ID NO: 4901) | CGGTGATTGGTACAAGAGTAG (SEQ ID NO: 4902) | GCTGGAATGGTACTCCTGAGTATGT (SEQ ID NO: 4903) |
| hCV30606396 | C/T | ACATTTGCTCATTCTGTACTCC (SEQ ID NO: 4904) | CACATTTGCTCATTCTGTACTCT (SEQ ID NO: 4905) | CAAGAGATCTGGAGGTGGGGATTAT (SEQ ID NO: 4906) |

TABLE 5-continued

| Marker | Alleles | Primer 1 (Allele-Specific Primer) | Primer 2 (Allele-Specific Primer) | Common Primer |
|---|---|---|---|---|
| hCV3068176 | A/G | TACCACAGCTTGCTCACAT (SEQ ID NO: 4907) | TACCACAGCTTGCTCACAC (SEQ ID NO: 4908) | TTTCCCCCATTTTTCAGTT (SEQ ID NO: 4909) |
| hCV30764105 | C/G | GGCCCTGAACCTTTCAG (SEQ ID NO: 4910) | GGCCCTGAACCTTTCAC (SEQ ID NO: 4911) | CGAATTAGTAAGTTACCAGTGACATCAGC (SEQ ID NO: 4912) |
| hCV3086932 | G/T | TGTATCGAGAGAGAAAGATAGTTTG (SEQ ID NO: 4913) | TTGTATCGAGAGAGAAAGATAGTTTT (SEQ ID NO: 4914) | CTCCACCAAATACCCTCATCTGTTCT (SEQ ID NO: 4915) |
| hCV3086948 | C/T | CTGGCATATTTTGAAGTATTCTCTG (SEQ ID NO: 4916) | CTCTGGCATATTTTGAAGTATTCTCTA (SEQ ID NO: 4917) | CTCTGGAAAGGGAAATGTCACTCTA (SEQ ID NO: 4918) |
| hCV3086950 | A/G | CTCCTTGCCTCAAATGATTTCT (SEQ ID NO: 4919) | TCCTTGCCTCAAATGATTTCC (SEQ ID NO: 4920) | TTCAGTCATACTCATGGTCCAAATCT-CATT (SEQ ID NO: 4921) |
| hCV3086961 | A/C | AAGCATCCAGAGCCTCTTAT (SEQ ID NO: 4922) | AGCATCCAGAGCCTCTTAG (SEQ ID NO: 4923) | GCTGTCCACCTGTCACTTTCATAAT (SEQ ID NO: 4924) |
| hCV3086983 | C/T | GCATAACTAAACTATAGTGTACAGACAC (SEQ ID NO: 4925) | GCATAACTAAACTATAGTGTACAGACAT (SEQ ID NO: 4926) | GACGTGGCCAGCCATCTTC (SEQ ID NO: 4927) |
| hCV3087000 | A/G | GAGCATAGAAACAATTTTGTTCCAT (SEQ ID NO: 4928) | AGCATAGAAACAATTTTGTTCCAC (SEQ ID NO: 4929) | AGTGTGTGGTTTCAGCAGTACTAGATT (SEQ ID NO: 4930) |
| hCV3087003 | C/G | CCTGGGCAAGATGGTAAAAC (SEQ ID NO: 4931) | CCTGGGCAAGATGGTAAAAG (SEQ ID NO: 4932) | CTGGGCTCAGGCAATCCTA (SEQ ID NO: 4933) |
| hCV3087008 | A/C | CAGAGTCCTTCAGTAAACTTCTTT (SEQ ID NO: 4934) | CAGAGTCCTTCAGTAAACTTCTTG (SEQ ID NO: 4935) | CCACCTTCTTTCAACCCAAATTTTCTC (SEQ ID NO: 4936) |
| hCV3087015 | C/G | ACAGCTTTTACTTACCTTTGATAGAG (SEQ ID NO: 4937) | ACAGCTTTTACTTACCTTTGATAGAC (SEQ ID NO: 4938) | AGCTGAGTGGGAGAAGAATACAC (SEQ ID NO: 4939) |
| hCV3087016 | A/C | AGCACTCCATAACTTTACCCT (SEQ ID NO: 4940) | GCACTCCATAACTTTACCCG (SEQ ID NO: 4941) | GACTACACACAAGATCAACTAATAGAAATACTGC (SEQ ID NO: 4942) |
| hCV3111721 | C/T | ACCGTTGTCCTCCC (SEQ ID NO: 4943) | GACCGTTGTCCTCCT (SEQ ID NO: 4944) | GCCTCTAGCACGATGGATAG (SEQ ID NO: 4945) |
| hCV3111822 | C/T | AAACCTTCCTACACAGAACTTC (SEQ ID NO: 4946) | AAACCTTCCTACACAGAACTTT (SEQ ID NO: 4947) | CTGGTGGTGGTGAGAAGAACAT (SEQ ID NO: 4948) |
| hCV31145250 | A/C | CTGAGCCACCTTATCTGTTAAAA (SEQ ID NO: 4949) | TGAGCCACCTTATCTGTTAAAC (SEQ ID NO: 4950) | CACAGGGTTGTTAACCTTGGTTTAG (SEQ ID NO: 4951) |
| hCV31161091 | A/G | ACACCTGCTGACTATCCAAT (SEQ ID NO: 4952) | CACCTGCTGACTATCCAAC (SEQ ID NO: 4953) | CATCGTGATCCTGCCAAGTAGAGA (SEQ ID NO: 4954) |
| hCV31237961 | A/C | GGCGAAGACAAAATTATATTTCAACT (SEQ ID NO: 4955) | GGCGAAGACAAAATTATATTTCAACG (SEQ ID NO: 4956) | CCAGGAAGCTCAGGCAAATTTGA (SEQ ID NO: 4957) |
| hCV3135085 | G/T | CTGGAAATGGTTATGGGC (SEQ ID NO: 4958) | TACTGGAAATGGTTATGGGA (SEQ ID NO: 4959) | TTTATAGGCGTGAAACTAATTCTC (SEQ ID NO: 4960) |
| hCV31356445 | G/T | GCCTGTGGTTGTCTTCCC (SEQ ID NO: 4961) | GCCTGTGGTTGTCTTCCA (SEQ ID NO: 4962) | ACTTCCTCAGGTCTGCTGTGT (SEQ ID NO: 4963) |
| hCV31466171 | A/G | CTCCAATCCCACATTTCCA (SEQ ID NO: 4964) | TCCAATCCCACATTTCCG (SEQ ID NO: 4965) | CCATGACTCTTCAGAACCTGTTTGT (SEQ ID NO: 4966) |
| hCV3152623 | A/C | CTGCAGAAACGATCAGTGT (SEQ ID NO: 4967) | TGCAGAAACGATCAGTGG (SEQ ID NO: 4968) | TGCTTCTGTCATTCTTTCTGAT (SEQ ID NO: 4969) |
| hCV31528409 | A/G | TGCCTGGACTGTGTTCTT (SEQ ID NO: 4970) | TGCCTGGACTGTGTTCTC (SEQ ID NO: 4971) | GAGGCAGAGGTTTCAGTGAGTAGA (SEQ ID NO: 4972) |
| hCV3168675 | A/G | TCTCCCACTGTGTTCCTA (SEQ ID NO: 4973) | CTCCCACTGTGTTCCTG (SEQ ID NO: 4974) | TGCCAGGGATTGGTTGCTTAATAC (SEQ ID NO: 4975) |
| hCV3170445 | C/T | GCTGCAAAAATGAACAACAC (SEQ ID NO: 4976) | GCTGCAAAAATGAACAACAT (SEQ ID NO: 4977) | GAATGCATAGCTGATCTCAAGA (SEQ ID NO: 4978) |

TABLE 5-continued

| Marker | Alleles | Primer 1 (Allele-Specific Primer) | Primer 2 (Allele-Specific Primer) | Common Primer |
|---|---|---|---|---|
| hCV3170459 | C/T | GACTGTCCTGATTGGAATCC (SEQ ID NO: 4979) | TGACTGTCCTGATTGGAATCT (SEQ ID NO: 4980) | GGCATTTTGGTATCATTTTGTTA (SEQ ID NO: 4981) |
| hCV3179059 | G/T | CATCCTCGTGGGAAGTG (SEQ ID NO: 4982) | CATCCTCGTGGGAAGTT (SEQ ID NO: 4983) | CCAACCTCTGCTCTCTGATAAT (SEQ ID NO: 4984) |
| hCV3180404 | A/G | CAGCAGAGCAGCCTTAA (SEQ ID NO: 4985) | CAGCAGAGCAGCCTTAG (SEQ ID NO: 4986) | TGATGCTGGAAGCACTTCT (SEQ ID NO: 4987) |
| hCV3181997 | A/G | TGGATCCTGACTTTGTGAAAT (SEQ ID NO: 4988) | TGGATCCTGACTTTGTGAAAC (SEQ ID NO: 4989) | GGAATCTGAAGGAGACATTTTTAC (SEQ ID NO: 4990) |
| hCV3187716 | A/C | CCTTCAATTCTGAAAAGTAGCTAAT (SEQ ID NO: 4991) | CCTTCAATTCTGAAAAGTAGCTAAG (SEQ ID NO: 4992) | TTTGAGGTTGAGTGACATGTTC (SEQ ID NO: 4993) |
| hCV31954792 | A/C | CCGGAGGCTAGATTATTACCT (SEQ ID NO: 4994) | CGGAGGCTAGATTATTACCG (SEQ ID NO: 4995) | ATCCCATTCCCTCCCTTCACATAA (SEQ ID NO: 4996) |
| hCV3201490 | A/G | GCAGTCCTGCCGTACT (SEQ ID NO: 4997) | GCAGTCCTGCCGTACC (SEQ ID NO: 4998) | ACTGCTCAACTACCTGGTGGATAAG (SEQ ID NO: 4999) |
| hCV32055474 | C/G | GAACAGTTCAGATTTACAAGTGC (SEQ ID NO: 5000) | AGAACAGTTCAGATTTACAAGTGG (SEQ ID NO: 5001) | CCACTGTTAACATTTGTTGTATGGT-CAGT (SEQ ID NO: 5002) |
| hCV32055477 | A/G | GAGTGCTAACAGAGTAATTACCAA (SEQ ID NO: 5003) | GAGTGCTAACAGAGTAATTACCAG (SEQ ID NO: 5004) | AAGGTCTCACCTGGTATGCTGTATTTT (SEQ ID NO: 5005) |
| hCV32055527 | A/C | ACACCCCAACGTCATCA (SEQ ID NO: 5006) | ACACCCCAACGTCATCC (SEQ ID NO: 5007) | AAGCCTTGGAAAGCGAAACTGT (SEQ ID NO: 5008) |
| hCV32055581 | A/G | GTGAGACAGCAAACACTATACA (SEQ ID NO: 5009) | TGAGACAGCAAACACTATACG (SEQ ID NO: 5010) | TTCCCGAAGAGCTGGAATTACAGT (SEQ ID NO: 5011) |
| hCV32055595 | C/T | ACCATCTACTATGAGCCTCC (SEQ ID NO: 5012) | AAACCATCTACTATGAGCCTCT (SEQ ID NO: 5013) | GTCTGTTGCCCATGGATGATTACA (SEQ ID NO: 5014) |
| hCV32055596 | A/G | GAAACTAGTTCTGTCTTCTAGCAT (SEQ ID NO: 5015) | GAAACTAGTTCTGTCTTCTAGCAC (SEQ ID NO: 5016) | GGGTCACAGACTTAGCCAGTGATA (SEQ ID NO: 5017) |
| hCV32055625 | C/T | CTTCAGACAAGCTGTCCTG (SEQ ID NO: 5018) | ATCTTCAGACAAGCTGTCCTA (SEQ ID NO: 5019) | GAAACCTAATTGGCCCAGGTCATC (SEQ ID NO: 5020) |
| hCV32055654 | A/G | TGATGCACAAGAGTGTTTACTTT (SEQ ID NO: 5021) | TGATGCACAAGAGTGTTTACTTC (SEQ ID NO: 5022) | GAGCTTGGATTAGGCAATGGTTTCT (SEQ ID NO: 5023) |
| hCV3215409 | A/G | GTGGCTCATTACCAATCTCTT (SEQ ID NO: 5024) | GTGGCTCATTACCAATCTCTC (SEQ ID NO: 5025) | GGGCTCCATCAACATCAC (SEQ ID NO: 5026) |
| hCV3219460 | G/T | GCAGGCCCCAGATGAG (SEQ ID NO: 5027) | GCAGGCCCCAGATGAT (SEQ ID NO: 5028) | CCATCCCACCCAGTCAA (SEQ ID NO: 5029) |
| hCV323070 | A/G | GCCCAGAAAGATGAGTTCA (SEQ ID NO: 5030) | GCCCAGAAAGATGAGTTCG (SEQ ID NO: 5031) | TGTCCCTTTTTCAGAGACATAGAT (SEQ ID NO: 5032) |
| hCV323071 | A/G | AAACCAGGATATCAGAACATTTTA (SEQ ID NO: 5033) | ACCAGGATATCAGAACATTTTG (SEQ ID NO: 5034) | GGTCTTAGGAATTATCTGACATCTT (SEQ ID NO: 5035) |
| hCV3242919 | A/C | GTGAGTTTTCGTCCCACT (SEQ ID NO: 5036) | TGAGTTTTCGTCCCACG (SEQ ID NO: 5037) | AAGTGGCCTTTTCTAAGGGGTAGAA (SEQ ID NO: 5038) |
| hCV3242952 | A/G | GCTATGTGGTTTGAAATTGTTCT (SEQ ID NO: 5039) | GCTATGTGGTTTGAAATTGTTCC (SEQ ID NO: 5040) | GGAGCACTGGGTCCTAGATGT (SEQ ID NO: 5041) |
| hCV3259235 | A/G | TCCTCTCCTTGTATCTTCACAT (SEQ ID NO: 5042) | TCCTCTCCTTGTATCTTCACAC (SEQ ID NO: 5043) | GAGGTAATCAGGTCATGAGGGTATAGT (SEQ ID NO: 5044) |
| hCV3275199 | A/G | CCATGCAACCAAACCAT (SEQ ID NO: 5045) | CCATGCAACCAAACCAC (SEQ ID NO: 5046) | CCTCTCATCCCTCTCATCTTT (SEQ ID NO: 5047) |
| hCV334752 | C/T | CTGTTCCAATATCTCTTTCCCC (SEQ ID NO: 5048) | TCTGTTCCAATATCTCTTTCCCT (SEQ ID NO: 5049) | GCAAACCATAGCACGCTTATACA (SEQ ID NO: 5050) |
| hCV341736 | C/T | GTCTGGTGACATAAGGTATTAAATTAATC (SEQ ID NO: 5051) | GTCTGGTGACATAAGGTATTAAATTAATT (SEQ ID NO: 5052) | AGGTGAATTACATAGGACCCTTTGTGT (SEQ ID NO: 5053) |

TABLE 5-continued

| Marker | Alleles | Primer 1 (Allele-Specific Primer) | Primer 2 (Allele-Specific Primer) | Common Primer |
|---|---|---|---|---|
| hCV342590 | C/T | AGACAAATTCTCTCATGTCCAC (SEQ ID NO: 5054) | AGACAAATTCTCTCATGTCCAT (SEQ ID NO: 5055) | TGTTTTTCCAGGAAAAAGATATTC (SEQ ID NO: 5056) |
| hCV361088 | A/G | CGACTTTCTAGAGGAAATTTAGGT (SEQ ID NO: 5057) | CGACTTTCTAGAGGAAATTTAGGC (SEQ ID NO: 5058) | CCCAGCAGTCCCGTTGCTTT (SEQ ID NO: 5059) |
| hCV370782 | C/T | TCTACCCAGGTACTTATCATCC (SEQ ID NO: 5060) | TTTCTACCCAGGTACTTATCATCT (SEQ ID NO: 5061) | GGATTCACTGTGAAAGAACAGTAT (SEQ ID NO: 5062) |
| hCV435368 | T/C | GAGGTCTTGAAATACAGGGATT (SEQ ID NO: 5063) | GAGGTCTTGAAATACAGGGATC (SEQ ID NO: 5064) | TCTTGAGAGGTGTGATCATAACTT (SEQ ID NO: 5065) |
| hCV461035 | C/T | TGTTTCCCTTATGACAACACG (SEQ ID NO: 5066) | CTGTTTCCCTTATGACAACACA (SEQ ID NO: 5067) | AGGGTCGGTCAAACTCATGCTATAT (SEQ ID NO: 5068) |
| hCV472000 | A/G | AAGAATTCACACCCAGGTTTATT (SEQ ID NO: 5069) | AGAATTCACACCCAGGTTTATC (SEQ ID NO: 5070) | CAACTCCTGAGTTCAAGCAGTCTG (SEQ ID NO: 5071) |
| hCV487868 | C/T | GCCACAATTTGGAGTTACAGG (SEQ ID NO: 5072) | GCCACAATTTGGAGTTACAGA (SEQ ID NO: 5073) | CCAATCCAGCCCTCTTGTGTTTG (SEQ ID NO: 5074) |
| hCV491676 | T/C | GAATTGCAAGTGCTTGTTTTAT (SEQ ID NO: 5075) | GAATTGCAAGTGCTTGTTTTAC (SEQ ID NO: 5076) | CCGATTCCCCAGTAACAAC (SEQ ID NO: 5077) |
| hCV529178 | C/T | TGGGTTGGTGGGCAG (SEQ ID NO: 5078) | TGGGTTGGTGGGCAA (SEQ ID NO: 5079) | GTGGCAGCCAATCTGAGTACT (SEQ ID NO: 5080) |
| hCV529706 | C/G | GCGAGGACGAAGGGG (SEQ ID NO: 5081) | GCGAGGACGAAGGGC (SEQ ID NO: 5082) | GGAGGATGAATGGACAGACAA (SEQ ID NO: 5083) |
| hCV529710 | C/G | CCGACCCGAACTAAAGG (SEQ ID NO: 5084) | CCGACCCGAACTAAAGC (SEQ ID NO: 5085) | CGCGTTCCCCATGTC (SEQ ID NO: 5086) |
| hCV537525 | A/C | TCATAGATCCCTACTTGTGCTAA (SEQ ID NO: 5087) | TCATAGATCCCTACTTGTGCTAC (SEQ ID NO: 5088) | CGCACTGTTCCCTTATCGAGATT (SEQ ID NO: 5089) |
| hCV5478 | C/T | CGGCTTTCTGGTGGG (SEQ ID NO: 5090) | ACGGCTTTCTGGTGGA (SEQ ID NO: 5091) | GGCTCCGAGGACGAGA (SEQ ID NO: 5092) |
| hCV549926 | C/T | ACCATGGTCACCCTGG (SEQ ID NO: 5093) | CACCATGGTCACCCTGA (SEQ ID NO: 5094) | GGACTGAAAGCAATGTGAGAG (SEQ ID NO: 5095) |
| hCV561574 | A/G | GCCATTTATGTAGCCAAACTGA (SEQ ID NO: 5096) | GCCATTTATGTAGCCAAACTGG (SEQ ID NO: 5097) | GCAGGTTATAAAGTGTGAGAGATCTGAGTA (SEQ ID NO: 5098) |
| hCV594695 | A/T | ATATCGTGGGTGAGTTCATTTA (SEQ ID NO: 5099) | TCGTGGGTGAGTTCATTTT (SEQ ID NO: 5100) | GGGTGCTGCTGATGAAATAC (SEQ ID NO: 5101) |
| hCV597227 | C/T | TTTCTGCAAACTAATTGACAGAAC (SEQ ID NO: 5102) | CTTTCTGCAAACTAATTGACAGAAT (SEQ ID NO: 5103) | GTCAAGTCCTTTCGGAAATGAGACA (SEQ ID NO: 5104) |
| hCV598677 | G/T | CCAAGCTGAAAGGCAAG (SEQ ID NO: 5105) | CCAAGCTGAAAGGCAAT (SEQ ID NO: 5106) | CAGCCAGGGTGGAGAGT (SEQ ID NO: 5107) |
| hCV601946 | A/G | CTCCATTCTCTTACCCCTCTTAT (SEQ ID NO: 5108) | TCCATTCTCTTACCCCTCTTAC (SEQ ID NO: 5109) | TTGGGGATGGACTCAAGATGTGT (SEQ ID NO: 5110) |
| hCV601961 | A/G | CCATTAATTATGAGTGCTCTTACCTAAA (SEQ ID NO: 5111) | CCATTAATTATGAGTGCTCTTACCTAAG (SEQ ID NO: 5112) | CCAACCACTCTGGTAGACGTGTAA (SEQ ID NO: 5113) |
| hCV601962 | A/G | AGCATAGAGGACTTCCTGTTT (SEQ ID NO: 5114) | AGCATAGAGGACTTCCTGTTC (SEQ ID NO: 5115) | GTGCTGGGATTACAGGCAAGAG (SEQ ID NO: 5116) |
| hCV610861 | C/T | TGGTGCTTGTTAAAATTTGCTG (SEQ ID NO: 5117) | GTGGTGCTTGTTAAAATTTGCTA (SEQ ID NO: 5118) | CTAAATCAGGTTTATTTGCCATGGAAGAGA (SEQ ID NO: 5119) |
| hCV621313 | C/T | TCCATGTGTCTGCTACCTC (SEQ ID NO: 5120) | TCCATGTGTCTGCTACCTT (SEQ ID NO: 5121) | CTCTTTCCCGGCATACCTGAAT (SEQ ID NO: 5122) |
| hCV7425232 | C/T | TCAAAATTATTTCTTGCTACAGG (SEQ ID NO: 5123) | GTCAAAATTATTTCTTGCTACAGA (SEQ ID NO: 5124) | TCCTCCAGCCTCTCATTC (SEQ ID NO: 5125) |

TABLE 5-continued

| Marker | Alleles | Primer 1 (Allele-Specific Primer) | Primer 2 (Allele-Specific Primer) | Common Primer |
|---|---|---|---|---|
| hCV7435390 | A/G | GTGGCCAGGGAAACAT (SEQ ID NO: 5126) | GTGGCCAGGGAAACAC (SEQ ID NO: 5127) | CCATGGCGAAGCAAATAT (SEQ ID NO: 5128) |
| hCV7441704 | A/G | CCAACCGAGATCAGATTGA (SEQ ID NO: 5129) | CAACCGAGATCAGATTGG (SEQ ID NO: 5130) | TGATGCTGATTGTGGATGATA (SEQ ID NO: 5131) |
| hCV7442005 | A/G | ACTTAACACTACTGAACTGTACATTT (SEQ ID NO: 5132) | ACTTAACACTACTGAACTGTACATTC (SEQ ID NO: 5133) | CACACACGCCCCTAAACAATAGAT (SEQ ID NO: 5134) |
| hCV7442014 | C/A | AGCAAAACCTTACAAATGTGAC (SEQ ID NO: 5135) | AGCAAAACCTTACAAATGTGAA (SEQ ID NO: 5136) | TTACCACATTCATTGCATTTG (SEQ ID NO: 5137) |
| hCV7443062 | T/C | GGAGCAGGATGGTGAT (SEQ ID NO: 5138) | GGAGCAGGATGGTGAC (SEQ ID NO: 5139) | GGAAATATCTCGTTCTTGTTCTCT (SEQ ID NO: 5140) |
| hCV7451269 | A/G | CTTCCACTCAGCTTCTTGT (SEQ ID NO: 5141) | TTCCACTCAGCTTCTTGC (SEQ ID NO: 5142) | GTAACGGGAGCCCCTACAC (SEQ ID NO: 5143) |
| hCV7475492 | C/T | CCAGACTTACCGATGTAGAC (SEQ ID NO: 5144) | CCAGACTTACCGATGTAGAT (SEQ ID NO: 5145) | GAGGGCCGCAGAGGT (SEQ ID NO: 5146) |
| hCV7480314 | C/T | GCATAGCCAAGGACTCCAC (SEQ ID NO: 5147) | GCATAGCCAAGGACTCCAT (SEQ ID NO: 5148) | AGGTGACAGGAGTCCCTACAAC (SEQ ID NO: 5149) |
| hCV7490135 | C/T | GCAGTCCTGAACAAAGTAGATG (SEQ ID NO: 5150) | CGCAGTCCTGAACAAAGTAGATA (SEQ ID NO: 5151) | CGTGCATGTTTTGAAAAATGTA (SEQ ID NO: 5152) |
| hCV7494810 | C/G | CCCGAGCGGACAGTG (SEQ ID NO: 5153) | CCCGAGCGGACAGTC (SEQ ID NO: 5154) | CAACTGCTGGCAGAATCTTC (SEQ ID NO: 5155) |
| hCV7499212 | C/T | GTGATGGTAGACACCTGGG (SEQ ID NO: 5156) | TGTGATGGTAGACACCTGGA (SEQ ID NO: 5157) | GGCTGCACGGACTCTTC (SEQ ID NO: 5158) |
| hCV7501549 | C/T | TCAGTTGTTGTGGGCTG (SEQ ID NO: 5159) | CTCAGTTGTTGTGGGCTA (SEQ ID NO: 5160) | GCCCACCTGCAAGGAATAGAG (SEQ ID NO: 5161) |
| hCV7504854 | A/G | TCTGGTGCGTAGAATTCCT (SEQ ID NO: 5162) | TGGTGCGTAGAATTCCC (SEQ ID NO: 5163) | ACAGCAGCAACGATCTCA (SEQ ID NO: 5164) |
| hCV7514870 | A/C | GAGCAGCAGGTTTGAGGT (SEQ ID NO: 5165) | GCAGCAGGTTTGAGGG (SEQ ID NO: 5166) | ACACCACCTGAACGTCTCTT (SEQ ID NO: 5167) |
| hCV7514879 | A/G | GGCTGAACCCCGTCCT (SEQ ID NO: 5168) | GCTGAACCCCGTCCC (SEQ ID NO: 5169) | CTTTTTCCTGCATCCTGTCT (SEQ ID NO: 5170) |
| hCV7537517 | C/G | CAGACCCCATTTTACAATAAAGC (SEQ ID NO: 5171) | TCAGACCCCATTTTACAATAAAGG (SEQ ID NO: 5172) | ACCTGGATTCTATTTTCATCCCATTAC ATAAGAG (SEQ ID NO: 5173) |
| hCV7577801 | C/T | CTTTGCTGCTCTGCC (SEQ ID NO: 5174) | CCTTTGCTGCTCTGCT (SEQ ID NO: 5175) | GGTCTCTGGTATTAAGTGGAAACA (SEQ ID NO: 5176) |
| hCV7618856 | C/T | GGCTCCCAATGTTAGTGC (SEQ ID NO: 5177) | TGGCTCCCAATGTTAGTGT (SEQ ID NO: 5178) | GGATTGGTTTGCATTTATTTTAGTA (SEQ ID NO: 5179) |
| hCV783138 | A/G | CATGCCACCCACTACCA (SEQ ID NO: 5180) | ATGCCACCCACTACCG (SEQ ID NO: 5181) | GAGCTTTTGCAGCCACTC (SEQ ID NO: 5182) |
| hCV783184 | G/T | TGCGAGTCAAATCTCAAGAC (SEQ ID NO: 5183) | TGCGAGTCAAATCTCAAGAA (SEQ ID NO: 5184) | CCTATTCCCGGCACTTCT (SEQ ID NO: 5185) |
| hCV7841642 | A/G | ACCAGCTCCAGGGTGTT (SEQ ID NO: 5186) | ACCAGCTCCAGGGTGTC (SEQ ID NO: 5187) | TGAAGTTTTGGAATGAGACTGAT (SEQ ID NO: 5188) |
| hCV7900503 | C/T | CGTCTCCAGGAAAATCATAAC (SEQ ID NO: 5189) | CGTCTCCAGGAAAATCATAAT (SEQ ID NO: 5190) | TGAGTTATTGCTACTTCAGAATCAT (SEQ ID NO: 5191) |
| hCV7910239 | A/G | CACTTTGTAACCTAAGAGATGCT (SEQ ID NO: 5192) | ACTTTGTAACCTAAGAGATGCC (SEQ ID NO: 5193) | GAGAACTCTAGTGAGTCTGTCCTTCAA (SEQ ID NO: 5194) |
| hCV795441 | C/G | TGTGGGCCAGGACG (SEQ ID NO: 5195) | CTGTGGGCCAGGACC (SEQ ID NO: 5196) | ACCCACCAGGACCTAAAAG (SEQ ID NO: 5197) |
| hCV795442 | A/G | CCATTCAATGCAATACGTCA (SEQ ID NO: 5198) | CATTCAATGCAATACGTCG (SEQ ID NO: 5199) | CCTCTCCTTCCAGAACCAGT (SEQ ID NO: 5200) |

TABLE 5-continued

| Marker | Alleles | Primer 1 (Allele-Specific Primer) | Primer 2 (Allele-Specific Primer) | Common Primer |
|---|---|---|---|---|
| hCV8072964 | A/T | CCTGATATCCTTGTTCATCAT (SEQ ID NO: 5201) | CCTGATATCCTTGTTCATCAA (SEQ ID NO: 5202) | TGTTACGGCTGCTATAATGTGT (SEQ ID NO: 5203) |
| hCV8157049 | C/T | AGAAGCTGTGTGTCTGGC (SEQ ID NO: 5204) | CAGAAGCTGTGTGTCTGGT (SEQ ID NO: 5205) | TGGGTAGATGTGGAATCAATAC (SEQ ID NO: 5206) |
| hCV818008 | C/T | GCGAGGTGAGCCCG (SEQ ID NO: 5207) | AGCGAGGTGAGCCCA (SEQ ID NO: 5208) | GGGATTATCCCAGGAAAGAC (SEQ ID NO: 5209) |
| hCV8369472 | A/G | CTTGACTGAAAAGTCTGGTCA (SEQ ID NO: 5210) | TTGACTGAAAAGTCTGGTCG (SEQ ID NO: 5211) | GTTTCATGGAGGGCTCAGAACT (SEQ ID NO: 5212) |
| hCV8379452 | C/T | TGATTGCTCTCCTTTGCC (SEQ ID NO: 5213) | GTGATTGCTCTCCTTTGCT (SEQ ID NO: 5214) | CCACCTGTATCTGCCATTTCTCT (SEQ ID NO: 5215) |
| hCV8420416 | C/T | CATTATGAGGGTTACAAGAATACTCC (SEQ ID NO: 5216) | ACATTATGAGGGTTACAAGAATACTCT (SEQ ID NO: 5217) | GGGAAACTCACTTCTGTAGGTAA (SEQ ID NO: 5218) |
| hCV8687255 | C/T | CCTGCTTCAGAGGCTGAC (SEQ ID NO: 5219) | CCTGCTTCAGAGGCTGAT (SEQ ID NO: 5220) | CCTCTTCTGGCCTTTCCATACAAT (SEQ ID NO: 5221) |
| hCV8696050 | A/G | GTGCCACGGTCAGGT (SEQ ID NO: 5222) | TGCCACGGTCAGGC (SEQ ID NO: 5223) | GTGCAACCACCACTTGTCTTTAGTT (SEQ ID NO: 5224) |
| hCV8696079 | G/T | CAACCTCAGTGGAAAGATGC (SEQ ID NO: 5225) | TCAACCTCAGTGGAAAGATGA (SEQ ID NO: 5226) | GCCCATGTGCAAAGGTCTCA (SEQ ID NO: 5227) |
| hCV8705506 | C/G | CCACTTCGGGTTCCTC (SEQ ID NO: 5228) | CCACTTCGGGTTCCTG (SEQ ID NO: 5229) | CCCTGGCTTAACATGA (SEQ ID NO: 5230) |
| hCV8708473 | A/G | GCAACAGGACACCTGAA (SEQ ID NO: 5231) | GCAACAGGACACCTGAG (SEQ ID NO: 5232) | GAGTGACAGGAGGCTGCTTA (SEQ ID NO: 5233) |
| hCV8709053 | A/G | GCCCAGATACCCCAAAA (SEQ ID NO: 5234) | GCCCAGATACCCCAAAG (SEQ ID NO: 5235) | GCCCAGCCTGCGTAGA (SEQ ID NO: 5236) |
| hCV8718197 | A/G | CCTCTGAGGCCTGAGAAA (SEQ ID NO: 5237) | CCTCTGAGGCCTGAGAAG (SEQ ID NO: 5238) | GTCCTGATTCCTCATTTCTTTC (SEQ ID NO: 5239) |
| hCV8722613 | C/T | CCTGGGGCAGGTACAG (SEQ ID NO: 5240) | CCTGGGGCAGGTACAA (SEQ ID NO: 5241) | CCATCCACTGCTTGAAAAG (SEQ ID NO: 5242) |
| hCV8726337 | A/G | CACATTCACGGTCACCTT (SEQ ID NO: 5243) | CACATTCACGGTCACCTC (SEQ ID NO: 5244) | CATTGCCCGAGCTCAA (SEQ ID NO: 5245) |
| hCV8737990 | C/T | GTCCTTGCAAGTATCCG (SEQ ID NO: 5246) | GGTCCTTGCAAGTATCCA (SEQ ID NO: 5247) | GCACTACAGCTGAGTCCTTTTC (SEQ ID NO: 5248) |
| hCV8784787 | A/C | ACTTCTGGGGCTTAGGAA (SEQ ID NO: 5249) | ACTTCTGGGGCTTAGGAC (SEQ ID NO: 5250) | TTCACCGGGAACTCTTGT (SEQ ID NO: 5251) |
| hCV8785824 | A/C | ATTTACAGAAGCTGCAAGAACT (SEQ ID NO: 5252) | ACAGAAGCTGCAAGAACG (SEQ ID NO: 5253) | CATTTTCTGTTTCTGGATCTGGCAGTAG (SEQ ID NO: 5254) |
| hCV8785827 | A/G | AGCAAGAACCAGTGATAGGTT (SEQ ID NO: 5255) | GCAAGAACCAGTGATAGGTC (SEQ ID NO: 5256) | CCTGTTGGCATGCTTGATGATG (SEQ ID NO: 5257) |
| hCV8804621 | A/G | AGGTTTCTTGGAGGAAGAGAT (SEQ ID NO: 5258) | AGGTTTCTTGGAGGAAGAGAC (SEQ ID NO: 5259) | GCACTGCACCCAGTGAG (SEQ ID NO: 5260) |
| hCV8804684 | A/T | TGTGTATATCCACGGCATTAT (SEQ ID NO: 5261) | TGTGTATATCCACGGCATTAA (SEQ ID NO: 5262) | TGCCCTCACCCAATATTC (SEQ ID NO: 5263) |
| hCV881283 | C/G | TCAGACACACAGGACACATG (SEQ ID NO: 5264) | TTCAGACACACAGGACACATC (SEQ ID NO: 5265) | CCCTTCTGCTCCCAGAAC (SEQ ID NO: 5266) |
| hCV8823713 | C/T | CCGTTATAATCGAAGGGACAC (SEQ ID NO: 5267) | TCCGTTATAATCGAAGGGACAT (SEQ ID NO: 5268) | GCTTCTCCACTTTCTCACATCAGT (SEQ ID NO: 5269) |
| hCV8824241 | G/A | AACAGAAAACGAAGTGATCATC (SEQ ID NO: 5270) | TAACAGAAAACGAAGTGATCATT (SEQ ID NO: 5271) | AGTTCAAGACGGGTCATATTC (SEQ ID NO: 5272) |
| hCV8824244 | C/T | CCTGTTGACTGACTCATAGGG (SEQ ID NO: 5273) | TCCTGTTGACTGACTCATAGGA (SEQ ID NO: 5274) | TTGGCCACATGTTCTATCTCTA (SEQ ID NO: 5275) |

TABLE 5-continued

| Marker | Alleles | Primer 1 (Allele-Specific Primer) | Primer 2 (Allele-Specific Primer) | Common Primer |
|---|---|---|---|---|
| hCV8824248 | A/G | AAAGCATAGGATGGGGACA (SEQ ID NO: 5276) | AGCATAGGATGGGGACG (SEQ ID NO: 5277) | CCTGGGTGACAGAGTGAGATTT (SEQ ID NO: 5278) |
| hCV8824394 | G/T | GTGAGTGTGATTTTGCTCAAC (SEQ ID NO: 5279) | TGTGAGTGTGATTTTGCTCAAA (SEQ ID NO: 5280) | CCCAAACCCCCAGAGAATAAGT (SEQ ID NO: 5281) |
| hCV8824424 | A/G | CATGGTGACCCCACATT (SEQ ID NO: 5282) | CATGGTGACCCCACATC (SEQ ID NO: 5283) | CCCACACAGCATGCTTTCTGAAT (SEQ ID NO: 5284) |
| hCV8824425 | A/C | GTTGGGATAGGCTTGTTTTGT (SEQ ID NO: 5285) | TTGGGATAGGCTTGTTTTGG (SEQ ID NO: 5286) | GCCTCCCTGTGAACAAACTAAAGT (SEQ ID NO: 5287) |
| hCV8824453 | G/T | TCCCTGAGGTGCTGAAG (SEQ ID NO: 5288) | TCCCTGAGGTGCTGAAT (SEQ ID NO: 5289) | GGCTGGTTCTGGCTTCTTTTATCTC (SEQ ID NO: 5290) |
| hCV8848630 | G/T | CATCTTCATCATCAAGGGAG (SEQ ID NO: 5291) | CATCTTCATCATCAAGGGAT (SEQ ID NO: 5292) | TGTTTTCCTCCCTCAGATATCT (SEQ ID NO: 5293) |
| hCV8851047 | T/C | CCTCAAAGGAAAAGGCTT (SEQ ID NO: 5294) | CCTCAAAGGAAAAGGCTC (SEQ ID NO: 5295) | GCGGACCATGTGTCAACT (SEQ ID NO: 5296) |
| hCV8851065 | C/G | CCCCGCAGAGAATTACC (SEQ ID NO: 5297) | CCCCGCAGAGAATTACG (SEQ ID NO: 5298) | ACGTCGCTGTCGAAGC (SEQ ID NO: 5299) |
| hCV8851085 | A/G | GCTCGTAGTTGTGTCTGCAT (SEQ ID NO: 5300) | GCTCGTAGTTGTGTCTGCAC (SEQ ID NO: 5301) | CGCTTCCTGGAGAGATACAT (SEQ ID NO: 5302) |
| hCV8851095 | C/T | CTCCACTTGGCAGG (SEQ ID NO: 5303) | GCTCCACTTGGCAGA (SEQ ID NO: 5304) | CACCAACCTGATCCGTAATG (SEQ ID NO: 5305) |
| hCV8881160 | C/T | TCCTAGAACATACAACAGTTTTAGC (SEQ ID NO: 5306) | TCCTAGAACATACAACAGTTTTAGT (SEQ ID NO: 5307) | GTGCCTAGCAGATGCCCAATAAATA (SEQ ID NO: 5308) |
| hCV8881161 | A/G | GAGAAAGTCCTCTATGAACTGATAA (SEQ ID NO: 5309) | GAGAAAGTCCTCTATGAACTGATAG (SEQ ID NO: 5310) | CCCCGTCTTTCTTATATGAAGGGTAGAA (SEQ ID NO: 5311) |
| hCV8881164 | C/T | AGAACACAAAATTTCTGTGATACAC (SEQ ID NO: 5312) | AAGAACACAAAATTTCTGTGATACAT (SEQ ID NO: 5313) | GATCCTCCCGGGCTCAAGT (SEQ ID NO: 5314) |
| hCV8888179 | C/T | GCCCTCTGCACACCTTC (SEQ ID NO: 5315) | GCCCTCTGCACACCTTT (SEQ ID NO: 5316) | GGTAGGAGGATCTGCAGTTGT (SEQ ID NO: 5317) |
| hCV8892418 | A/G | GAGACCAGTCTGACTTACACT (SEQ ID NO: 5318) | AGACCAGTCTGACTTACACC (SEQ ID NO: 5319) | GCCCGGCCTTCCTAGTATT (SEQ ID NO: 5320) |
| hCV8895373 | A/G | AGGACTTCCGTGTCTT (SEQ ID NO: 5321) | AGGACTTCCGTGTCTC (SEQ ID NO: 5322) | ACAGATGCCAGCAATACAGA (SEQ ID NO: 5323) |
| hCV8901525 | G/A | CAGCTCACGCAGCG (SEQ ID NO: 5324) | TCAGCTCACGCAGCA (SEQ ID NO: 5325) | CTTGTTGGAGTGTGTGAATAAGA (SEQ ID NO: 5326) |
| hCV8921288 | C/A | CCGCAGAGGTGTGGG (SEQ ID NO: 5327) | CCGCAGAGGTGTGGT (SEQ ID NO: 5328) | CATTTTGCGGTGGAAATG (SEQ ID NO: 5329) |
| hCV8936042 | C/T | ACGAGAATCTTCTCCTACACG (SEQ ID NO: 5330) | ACGAGAATCTTCTCCTACACA (SEQ ID NO: 5331) | GTGTGACCCACTCTTGAAAGACAT (SEQ ID NO: 5332) |
| hCV904973 | C/T | TCCTCCGCGATGCCGATGACCTGCAGAATC (SEQ ID NO: 5333) | TCCTCCGCGATGCCGATGACCTGCAGAATT (SEQ ID NO: 5334) | TCGCGGGCCCCGGCCTGGTACA (SEQ ID NO: 5335) |
| hCV904974 | C/T | GCCGGCACTCTCTTCC (SEQ ID NO: 5336) | GCCGGCACTCTCTTCT (SEQ ID NO: 5337) | CAGAGGGACAAGCAGATGT (SEQ ID NO: 5338) |
| hCV9055799 | C/G | ACAGATCCATTTCATCTAGGTC (SEQ ID NO: 5339) | ACAGATCCATTTCATCTAGGTG (SEQ ID NO: 5340) | GGCTCTGGGAATTCACAT (SEQ ID NO: 5341) |
| hCV9077561 | G/A | AGAAGGTGGGATCCAAAC (SEQ ID NO: 5342) | AGAAGGTGGGATCCAAAT (SEQ ID NO: 5343) | AGAAACCATCATGCTGAGGT (SEQ ID NO: 5344) |
| hCV922535 | A/G | AAACCAAGACTCTGGCAAAT (SEQ ID NO: 5345) | AACCAAGACTCTGGCAAAC (SEQ ID NO: 5346) | TTCCCAGCTGACCCAGTTCT (SEQ ID NO: 5347) |
| hCV9326822 | C/T | CTCGGGACCAGTCCAG (SEQ ID NO: 5348) | CTCGGGACCAGTCCAA (SEQ ID NO: 5349) | CCGACAGCCGAGGAGA (SEQ ID NO: 5350) |

TABLE 5-continued

| Marker | Alleles | Primer 1 (Allele-Specific Primer) | Primer 2 (Allele-Specific Primer) | Common Primer |
|---|---|---|---|---|
| hCV9494470 | G/T | AGGGATCCGCAAAGC (SEQ ID NO: 5351) | CAGGGATCCGCAAAGA (SEQ ID NO: 5352) | TCTTTCTGCCAGGTACATCA (SEQ ID NO: 5353) |
| hCV9506149 | A/T | CTGCTGGCCGTCCT (SEQ ID NO: 5354) | TGCTGGCCGTCCA (SEQ ID NO: 5355) | ACTCACGCTTGCTTTGACT (SEQ ID NO: 5356) |
| hCV9528413 | G/C | GTCGTCCTGCTGATTTCC (SEQ ID NO: 5357) | TCGTCCTGCTGATTTCG (SEQ ID NO: 5358) | GGAAGGCCGGGATACTC (SEQ ID NO: 5359) |
| hCV9549398 | A/G | TCCTGCACTGTATGATATATGTGA (SEQ ID NO: 5360) | CCTGCACTGTATGATATATGTGG (SEQ ID NO: 5361) | CAAAAGTCAACAAATGTGTTTACATA (SEQ ID NO: 5362) |
| hCV9581635 | C/G | CTGGAGTAATAACAGGAATACTGTC (SEQ ID NO: 5363) | CTGGAGTAATAACAGGAATACTGTG (SEQ ID NO: 5364) | CACTGCAAGTCTGTCTCACATAGGA (SEQ ID NO: 5365) |
| hCV9588862 | C/T | AGCTGAGGGAACAATATTAACG (SEQ ID NO: 5366) | AAGCTGAGGGAACAATATTAACA (SEQ ID NO: 5367) | GCCACCTGGGAAAGGCTAAAT (SEQ ID NO: 5368) |
| hCV9589513 | C/G | GTGATGGATGCCACTGTC (SEQ ID NO: 5369) | TGATGGATGCCACTGTG (SEQ ID NO: 5370) | CCTGAGTTTTTTGACACATCTCT (SEQ ID NO: 5371) |
| hCV9596963 | A/G | TGCCCCCAGCCAGAA (SEQ ID NO: 5372) | TGCCCCAGCCAGAG (SEQ ID NO: 5373) | GGCCCTCCAGGATCTG (SEQ ID NO: 5374) |
| hCV9604851 | A/G | CCGCCTTGCAGATGAT (SEQ ID NO: 5375) | CCGCCTTGCAGATGAC (SEQ ID NO: 5376) | GGAGCTGGCCATTAGAATC (SEQ ID NO: 5377) |
| hCV997884 | A/G | CGGTGTCAGCACCTTTGA (SEQ ID NO: 5378) | GGTGTCAGCACCTTTGG (SEQ ID NO: 5379) | CCCCCAAGCAACCACA (SEQ ID NO: 5380) |
| hDV68873046 | A/T | TGGGATGAATTCTTCAATGATAAGAT (SEQ ID NO: 5381) | TGGGATGAATTCTTCAATGATAAGAA (SEQ ID NO: 5382) | TGCTGGTGCCTGTACCT (SEQ ID NO: 5383) |
| hDV70661573 | A/T | CCTGTGGTCGCCATCAA (SEQ ID NO: 5384) | CCTGTGGTCGCCATCAT (SEQ ID NO: 5385) | TTCAGGCTGTTCAGACAGTAGTG (SEQ ID NO: 5386) |
| hDV70715669 | A/T | GATTTGATTGGAGTCCAGGAAA (SEQ ID NO: 5387) | GATTTGATTGGAGTCCAGGAAT (SEQ ID NO: 5388) | CTGCTCCCAGCTCCAGTTTATC (SEQ ID NO: 5389) |
| hDV70751699 | A/T | GGGCCATTTCTGCTGTA (SEQ ID NO: 5390) | GGGCCATTTCTGCTGTT (SEQ ID NO: 5391) | CCAGACCCCAACTCAGTAGTAGAT (SEQ ID NO: 5392) |
| hDV70751704 | A/T | CTCTTCTCGCCCCAGA (SEQ ID NO: 5393) | CTCTTCTCGCCCCAGT (SEQ ID NO: 5394) | AGAACACAGGCTTACACGCTTTTC (SEQ ID NO: 5395) |
| hDV70751706 | C/G | GTGGCTTCGTCATGTAGG (SEQ ID NO: 5396) | GTGGCTTCGTCATGTAGC (SEQ ID NO: 5397) | CGTGTAAGCCTGTGTTCTTTCTGAA (SEQ ID NO: 5398) |
| hDV70797856 | C/T | AAAGGTGCAAAACATCCAATTC (SEQ ID NO: 5399) | GAAAGGTGCAAAACATCCAATTT (SEQ ID NO: 5400) | CCCAGGCTAGTCTTGAACTTCT (SEQ ID NO: 5401) |
| hDV70938014 | A/G | ACTTCGTCCTCTTCATACCTA (SEQ ID NO: 5402) | CTTTCGTCCTCTTCATACCTG (SEQ ID NO: 5403) | GGGGTTCACTCTTGGTACCTTCTT (SEQ ID NO: 5404) |
| hDV70973697 | C/T | GCCATGAGACATAACATGCTTC (SEQ ID NO: 5405) | GCCATGAGACATAACATGCTTT (SEQ ID NO: 5406) | CGGCTTAAGGCAGAACATTTAGAGA (SEQ ID NO: 5407) |
| hDV70977122 | A/G | GGACAGTGGTGCTAGTAGTT (SEQ ID NO: 5408) | GGACAGTGGTGCTAGTAGTC (SEQ ID NO: 5409) | ACCCTGACCACTCTGGAACATAC (SEQ ID NO: 5410) |
| hDV76976592 | A/G | CTTCCAGAAAGCTCTGGGA (SEQ ID NO: 5411) | TCCAGAAAGCTCTGGGG (SEQ ID NO: 5412) | CAGGTCAACAGAGCCTACGAATAAT (SEQ ID NO: 5413) |

TABLE 6

| Interrogated SNP (hCV #) | Interrogated SNP (rs #) | LD SNP (hCV #) | LD SNP (rs #) | Power | Threshold r² | r² |
|---|---|---|---|---|---|---|
| hCV10048483 | rs2145270 | hCV10048484 | rs1000972 | 0.51 | 0.9 | 0.9242 |
| hCV10048483 | rs2145270 | hCV10048501 | rs979012 | 0.51 | 0.9 | 0.9242 |
| hCV10048483 | rs2145270 | hCV2513354 | rs6054427 | 0.51 | 0.9 | 1 |
| hCV1026586 | rs673548 | hCV11168489 | rs2678379 | 0.51 | 0.9 | 1 |
| hCV1026586 | rs673548 | hCV11168524 | rs6544366 | 0.51 | 0.9 | 0.9441 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV1026586 | rs673548 | hCV11168530 | rs6728178 | 0.51 | 0.9 | 0.9441 |
| hCV1026586 | rs673548 | hCV260164 | rs6754295 | 0.51 | 0.9 | 0.9441 |
| hCV1026586 | rs673548 | hCV30847428 | rs11902417 | 0.51 | 0.9 | 0.9441 |
| hCV1026586 | rs673548 | hCV3216558 | rs676210 | 0.51 | 0.9 | 1 |
| hCV1026586 | rs673548 | hCV7615376 | rs1042034 | 0.51 | 0.9 | 0.9709 |
| hCV11170747 | rs2066853 | hCV15956280 | rs2237297 | 0.51 | 0.9 | 1 |
| hCV11170747 | rs2066853 | hCV16163703 | rs2074113 | 0.51 | 0.9 | 1 |
| hCV11170747 | rs2066853 | hCV29793055 | rs10274243 | 0.51 | 0.9 | 1 |
| hCV11231076 | rs4857855 | hCV487869 | rs4431128 | 0.51 | 0.9 | 1 |
| hCV11398434 | rs1812457 | hCV11398437 | rs1817367 | 0.51 | 0.515519235 | 1 |
| hCV11398434 | rs1812457 | hCV11675962 | rs10746481 | 0.51 | 0.515519235 | 0.9381 |
| hCV11398434 | rs1812457 | hCV1188731 | rs4908514 | 0.51 | 0.515519235 | 0.8094 |
| hCV11398434 | rs1812457 | hCV1188735 | rs10864366 | 0.51 | 0.515519235 | 0.7979 |
| hCV11398434 | rs1812457 | hCV15882429 | rs2289732 | 0.51 | 0.515519235 | 0.5975 |
| hCV11398434 | rs1812457 | hCV15932991 | rs2781067 | 0.51 | 0.515519235 | 0.5861 |
| hCV11398434 | rs1812457 | hCV27157507 | rs6664000 | 0.51 | 0.515519235 | 0.7979 |
| hCV11398434 | rs1812457 | hCV27157524 | rs6577531 | 0.51 | 0.515519235 | 0.7539 |
| hCV11398434 | rs1812457 | hCV2741759 | rs11121179 | 0.51 | 0.515519235 | 0.5747 |
| hCV11398434 | rs1812457 | hCV27884601 | rs4908776 | 0.51 | 0.515519235 | 0.8089 |
| hCV11398434 | rs1812457 | hCV27958354 | rs4908762 | 0.51 | 0.515519235 | 0.8759 |
| hCV11398434 | rs1812457 | hCV28023091 | rs4908773 | 0.51 | 0.515519235 | 0.7979 |
| hCV11398434 | rs1812457 | hCV29368919 | rs4908513 | 0.51 | 0.515519235 | 0.8094 |
| hCV11398434 | rs1812457 | hCV2943451 | rs902355 | 0.51 | 0.515519235 | 0.6736 |
| hCV11398434 | rs1812457 | hCV2943853 | rs301793 | 0.51 | 0.515519235 | 0.5975 |
| hCV11398434 | rs1812457 | hCV2966436 | rs11121174 | 0.51 | 0.515519235 | 0.5975 |
| hCV11398434 | rs1812457 | hCV2966437 | rs11580417 | 0.51 | 0.515519235 | 0.5975 |
| hCV11398434 | rs1812457 | hCV2966441 | rs6684863 | 0.51 | 0.515519235 | 0.5975 |
| hCV11398434 | rs1812457 | hCV2966444 | rs11121171 | 0.51 | 0.515519235 | 0.6417 |
| hCV11398434 | rs1812457 | hCV29819064 | rs6698079 | 0.51 | 0.515519235 | 1 |
| hCV11398434 | rs1812457 | hCV2987250 | rs301810 | 0.51 | 0.515519235 | 0.7861 |
| hCV11398434 | rs1812457 | hCV29873524 | rs7533113 | 0.51 | 0.515519235 | 0.8094 |
| hCV11398434 | rs1812457 | hCV29873526 | rs6697997 | 0.51 | 0.515519235 | 0.8824 |
| hCV11398434 | rs1812457 | hCV29945430 | rs7517436 | 0.51 | 0.515519235 | 0.7979 |
| hCV11398434 | rs1812457 | hCV30035535 | rs7518204 | 0.51 | 0.515519235 | 0.8087 |
| hCV11398434 | rs1812457 | hCV30125699 | rs4581300 | 0.51 | 0.515519235 | 0.8759 |
| hCV11398434 | rs1812457 | hCV30143725 | rs6690050 | 0.51 | 0.515519235 | 0.9381 |
| hCV11398434 | rs1812457 | hCV30467730 | rs6702457 | 0.51 | 0.515519235 | 0.9381 |
| hCV11398434 | rs1812457 | hCV3086930 | rs6658881 | 0.51 | 0.515519235 | 0.9345 |
| hCV11398434 | rs1812457 | hCV3086932 | rs7533442 | 0.51 | 0.515519235 | 0.9345 |
| hCV11398434 | rs1812457 | hCV3086950 | rs4908771 | 0.51 | 0.515519235 | 0.9381 |
| hCV11398434 | rs1812457 | hCV3086961 | rs6703577 | 0.51 | 0.515519235 | 1 |
| hCV11398434 | rs1812457 | hCV3086971 | rs6679948 | 0.51 | 0.515519235 | 1 |
| hCV11398434 | rs1812457 | hCV3086972 | rs6688329 | 0.51 | 0.515519235 | 1 |
| hCV11398434 | rs1812457 | hCV3086998 | rs7530863 | 0.51 | 0.515519235 | 0.8759 |
| hCV11398434 | rs1812457 | hCV3087000 | rs1463055 | 0.51 | 0.515519235 | 0.8824 |
| hCV11398434 | rs1812457 | hCV3087003 | rs6577500 | 0.51 | 0.515519235 | 0.8824 |
| hCV11398434 | rs1812457 | hCV3087015 | rs11121198 | 0.51 | 0.515519235 | 0.8824 |
| hCV11398434 | rs1812457 | hCV3087016 | rs2297867 | 0.51 | 0.515519235 | 0.8759 |
| hCV11398434 | rs1812457 | hCV32055284 | rs12079653 | 0.51 | 0.515519235 | 0.6858 |
| hCV11398434 | rs1812457 | hCV32055470 | rs6577506 | 0.51 | 0.515519235 | 1 |
| hCV11398434 | rs1812457 | hCV32055474 | rs10864359 | 0.51 | 0.515519235 | 1 |
| hCV11398434 | rs1812457 | hCV32055477 | rs10779705 | 0.51 | 0.515519235 | 1 |
| hCV11398434 | rs1812457 | hCV32055527 | rs10864364 | 0.51 | 0.515519235 | 0.7979 |
| hCV11398434 | rs1812457 | hCV32055548 | rs11121197 | 0.51 | 0.515519235 | 0.8824 |
| hCV11398434 | rs1812457 | hCV32055579 | rs6577522 | 0.51 | 0.515519235 | 0.8092 |
| hCV11398434 | rs1812457 | hCV32055595 | rs6577524 | 0.51 | 0.515519235 | 0.8094 |
| hCV11398434 | rs1812457 | hCV32055596 | rs6577525 | 0.51 | 0.515519235 | 0.7979 |
| hCV11398434 | rs1812457 | hCV32055625 | rs6678590 | 0.51 | 0.515519235 | 0.7684 |
| hCV11398434 | rs1812457 | hCV32055637 | rs6577532 | 0.51 | 0.515519235 | 0.7394 |
| hCV11398434 | rs1812457 | hCV32055662 | rs6677249 | 0.51 | 0.515519235 | 0.5758 |
| hCV11398434 | rs1812457 | hCV32055677 | rs10864355 | 0.51 | 0.515519235 | 0.8824 |
| hCV11398434 | rs1812457 | hCV529178 | rs301811 | 0.51 | 0.515519235 | 0.8824 |
| hCV11398434 | rs1812457 | hCV529182 | rs301800 | 0.51 | 0.515519235 | 0.6217 |
| hCV11398434 | rs1812457 | hCV597227 | rs301809 | 0.51 | 0.515519235 | 0.8824 |
| hCV11398434 | rs1812457 | hCV597229 | rs301785 | 0.51 | 0.515519235 | 0.8824 |
| hCV11398434 | rs1812457 | hCV877241 | rs301788 | 0.51 | 0.515519235 | 0.5747 |
| hCV11398434 | rs1812457 | hCV8823713 | rs1472228 | 0.51 | 0.515519235 | 0.7979 |
| hCV11398434 | rs1812457 | hCV8824288 | rs910582 | 0.51 | 0.515519235 | 0.8824 |
| hCV11398434 | rs1812457 | hCV8824394 | rs1443929 | 0.51 | 0.515519235 | 0.5747 |
| hCV11398434 | rs1812457 | hCV8824424 | rs1058790 | 0.51 | 0.515519235 | 0.6417 |
| hCV11398434 | rs1812457 | hCV8824425 | rs1058791 | 0.51 | 0.515519235 | 0.62 |
| hCV11398434 | rs1812457 | hCV8881145 | rs1038008 | 0.51 | 0.515519235 | 1 |
| hCV11398434 | rs1812457 | hCV8881146 | rs1463054 | 0.51 | 0.515519235 | 1 |
| hCV11398434 | rs1812457 | hCV8881157 | rs1535158 | 0.51 | 0.515519235 | 1 |
| hCV11398434 | rs1812457 | hCV8881161 | rs926951 | 0.51 | 0.515519235 | 0.8759 |
| hCV11398437 | rs1817367 | hCV11398434 | rs1812457 | 0.51 | 0.883097369 | 1 |
| hCV11398437 | rs1817367 | hCV11675962 | rs10746481 | 0.51 | 0.883097369 | 0.9276 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV11398437 | rs1817367 | hCV27958354 | rs4908762 | 0.51 | 0.883097369 | 0.8987 |
| hCV11398437 | rs1817367 | hCV29819064 | rs6698079 | 0.51 | 0.883097369 | 1 |
| hCV11398437 | rs1817367 | hCV30125699 | rs4581300 | 0.51 | 0.883097369 | 0.8936 |
| hCV11398437 | rs1817367 | hCV30143725 | rs6690050 | 0.51 | 0.883097369 | 0.9276 |
| hCV11398437 | rs1817367 | hCV30467730 | rs6702457 | 0.51 | 0.883097369 | 0.9276 |
| hCV11398437 | rs1817367 | hCV3086950 | rs4908771 | 0.51 | 0.883097369 | 0.9276 |
| hCV11398437 | rs1817367 | hCV3086961 | rs6703577 | 0.51 | 0.883097369 | 0.9642 |
| hCV11398437 | rs1817367 | hCV3086971 | rs6679948 | 0.51 | 0.883097369 | 1 |
| hCV11398437 | rs1817367 | hCV3086972 | rs6688329 | 0.51 | 0.883097369 | 1 |
| hCV11398437 | rs1817367 | hCV3086998 | rs7530863 | 0.51 | 0.883097369 | 0.8987 |
| hCV11398437 | rs1817367 | hCV32055470 | rs6577506 | 0.51 | 0.883097369 | 0.9642 |
| hCV11398437 | rs1817367 | hCV32055474 | rs10864359 | 0.51 | 0.883097369 | 0.8987 |
| hCV11398437 | rs1817367 | hCV32055477 | rs10779705 | 0.51 | 0.883097369 | 1 |
| hCV11398437 | rs1817367 | hCV8881145 | rs1038008 | 0.51 | 0.883097369 | 1 |
| hCV11398437 | rs1817367 | hCV8881146 | rs1463054 | 0.51 | 0.883097369 | 1 |
| hCV11398437 | rs1817367 | hCV8881157 | rs1535158 | 0.51 | 0.883097369 | 1 |
| hCV11398437 | rs1817367 | hCV8881161 | rs926951 | 0.51 | 0.883097369 | 0.8987 |
| hCV11438723 | rs1877273 | hCV15830836 | rs2859641 | 0.51 | 0.9 | 1 |
| hCV11438723 | rs1877273 | hCV15868592 | rs2941949 | 0.51 | 0.9 | 0.9549 |
| hCV11438723 | rs1877273 | hCV15912032 | rs2667617 | 0.51 | 0.9 | 0.9549 |
| hCV11438723 | rs1877273 | hCV15912048 | rs2667611 | 0.51 | 0.9 | 0.9549 |
| hCV11438723 | rs1877273 | hCV15912085 | rs2667632 | 0.51 | 0.9 | 1 |
| hCV11438723 | rs1877273 | hCV15912105 | rs2667623 | 0.51 | 0.9 | 1 |
| hCV11438723 | rs1877273 | hCV1592156 | rs2738745 | 0.51 | 0.9 | 0.9549 |
| hCV11438723 | rs1877273 | hCV1592157 | rs2667614 | 0.51 | 0.9 | 1 |
| hCV11438723 | rs1877273 | hCV1592158 | rs3106331 | 0.51 | 0.9 | 1 |
| hCV11438723 | rs1877273 | hCV16290607 | rs2738494 | 0.51 | 0.9 | 1 |
| hCV11438723 | rs1877273 | hCV16290609 | rs2257074 | 0.51 | 0.9 | 1 |
| hCV11438723 | rs1877273 | hCV16291171 | rs2738743 | 0.51 | 0.9 | 0.9082 |
| hCV11438723 | rs1877273 | hCV27271636 | rs2941952 | 0.51 | 0.9 | 1 |
| hCV11438723 | rs1877273 | hCV8897017 | rs2859644 | 0.51 | 0.9 | 1 |
| hCV11438723 | rs1877273 | hCV8897018 | rs1105313 | 0.51 | 0.9 | 1 |
| hCV11446935 | rs2409722 | hCV231938 | rs7813802 | 0.51 | 0.9 | 0.9623 |
| hCV11446935 | rs2409722 | hCV30011529 | rs7819412 | 0.51 | 0.9 | 1 |
| hCV11568668 | rs1317538 | hCV502935 | rs12526735 | 0.51 | 0.9 | 1 |
| hCV11568668 | rs1317538 | hCV502936 | rs1317537 | 0.51 | 0.9 | 0.9429 |
| hCV11592758 | rs6265 | hCV12035465 | rs2049045 | 0.51 | 0.9 | 1 |
| hCV11592758 | rs6265 | hCV30726493 | rs11030084 | 0.51 | 0.9 | 1 |
| hCV11678789 | rs7219148 | hCV2536560 | rs11078773 | 0.51 | 0.9 | 1 |
| hCV11697322 | rs1926447 | hCV11697321 | rs1926446 | 0.51 | 0.9 | 1 |
| hCV11697322 | rs1926447 | hCV16228638 | rs2404727 | 0.51 | 0.9 | 0.9127 |
| hCV11761245 | rs7043149 | hCV11759640 | rs7850573 | 0.51 | 0.493197647 | 0.6145 |
| hCV11761245 | rs7043149 | hCV11759644 | rs6560584 | 0.51 | 0.493197647 | 0.6145 |
| hCV11761245 | rs7043149 | hCV11759645 | rs7034303 | 0.51 | 0.493197647 | 0.6145 |
| hCV11761245 | rs7043149 | hCV11759647 | rs7048937 | 0.51 | 0.493197647 | 0.6145 |
| hCV11761245 | rs7043149 | hCV11760387 | rs2309422 | 0.51 | 0.493197647 | 0.6665 |
| hCV11761245 | rs7043149 | hCV11760421 | rs12056979 | 0.51 | 0.493197647 | 0.6798 |
| hCV11761245 | rs7043149 | hCV11761216 | rs7874888 | 0.51 | 0.493197647 | 0.6376 |
| hCV11761245 | rs7043149 | hCV11761223 | rs2309426 | 0.51 | 0.493197647 | 0.6358 |
| hCV11761245 | rs7043149 | hCV11761237 | rs4329331 | 0.51 | 0.493197647 | 0.6712 |
| hCV11761245 | rs7043149 | hCV11761239 | rs4338173 | 0.51 | 0.493197647 | 0.6684 |
| hCV11761245 | rs7043149 | hCV1844076 | rs1339546 | 0.51 | 0.493197647 | 0.6528 |
| hCV11761245 | rs7043149 | hCV20896 | rs2309424 | 0.51 | 0.493197647 | 0.6528 |
| hCV11761245 | rs7043149 | hCV25805877 | rs3750549 | 0.51 | 0.493197647 | 0.6518 |
| hCV11761245 | rs7043149 | hCV26566188 | rs4375066 | 0.51 | 0.493197647 | 0.6742 |
| hCV11761245 | rs7043149 | hCV26566190 | rs3927676 | 0.51 | 0.493197647 | 0.6742 |
| hCV11761245 | rs7043149 | hCV26566432 | rs4076288 | 0.51 | 0.493197647 | 0.8065 |
| hCV11761245 | rs7043149 | hCV26566437 | rs4421408 | 0.51 | 0.493197647 | 0.6798 |
| hCV11761245 | rs7043149 | hCV26566445 | rs4339703 | 0.51 | 0.493197647 | 0.8124 |
| hCV11761245 | rs7043149 | hCV27970553 | rs5006364 | 0.51 | 0.493197647 | 0.8124 |
| hCV11761245 | rs7043149 | hCV27996874 | rs4745701 | 0.51 | 0.493197647 | 0.944 |
| hCV11761245 | rs7043149 | hCV29169289 | rs6560585 | 0.51 | 0.493197647 | 0.6145 |
| hCV11761245 | rs7043149 | hCV29577088 | rs9314865 | 0.51 | 0.493197647 | 0.6528 |
| hCV11761245 | rs7043149 | hCV29830130 | rs10217168 | 0.51 | 0.493197647 | 0.6528 |
| hCV11761245 | rs7043149 | hCV30172680 | rs10122932 | 0.51 | 0.493197647 | 0.6237 |
| hCV11761245 | rs7043149 | hCV30532761 | rs10125494 | 0.51 | 0.493197647 | 0.6798 |
| hCV11761245 | rs7043149 | hCV31363642 | rs7862404 | 0.51 | 0.493197647 | 0.6667 |
| hCV11761245 | rs7043149 | hCV31363652 | rs10869961 | 0.51 | 0.493197647 | 0.6798 |
| hCV11761245 | rs7043149 | hCV31363664 | rs10869975 | 0.51 | 0.493197647 | 0.6433 |
| hCV11761245 | rs7043149 | hCV31363697 | rs7041781 | 0.51 | 0.493197647 | 0.639 |
| hCV11761245 | rs7043149 | hCV31364135 | rs10781440 | 0.51 | 0.493197647 | 0.6334 |
| hCV11761245 | rs7043149 | hCV31364138 | rs7865373 | 0.51 | 0.493197647 | 0.6334 |
| hCV11761245 | rs7043149 | hCV31364140 | rs7467352 | 0.51 | 0.493197647 | 0.6721 |
| hCV11761245 | rs7043149 | hCV31364141 | rs11145460 | 0.51 | 0.493197647 | 0.699 |
| hCV11761245 | rs7043149 | hCV446682 | rs2309427 | 0.51 | 0.493197647 | 0.6376 |
| hCV11761245 | rs7043149 | hCV450641 | rs10781456 | 0.51 | 0.493197647 | 0.6334 |
| hCV11761245 | rs7043149 | hCV453560 | rs10869992 | 0.51 | 0.493197647 | 0.6687 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV11761245 | rs7043149 | hCV453561 | rs10869993 | 0.51 | 0.493197647 | 0.6694 |
| hCV11761245 | rs7043149 | hCV453562 | rs10869994 | 0.51 | 0.493197647 | 0.6712 |
| hCV11761245 | rs7043149 | hCV453563 | rs10869997 | 0.51 | 0.493197647 | 0.6848 |
| hCV11761245 | rs7043149 | hCV456556 | rs4076287 | 0.51 | 0.493197647 | 0.6762 |
| hCV11761245 | rs7043149 | hCV463630 | rs2486451 | 0.51 | 0.493197647 | 1 |
| hCV11761245 | rs7043149 | hCV500456 | rs10869976 | 0.51 | 0.493197647 | 0.7161 |
| hCV11761245 | rs7043149 | hCV7441996 | rs867346 | 0.51 | 0.493197647 | 0.6897 |
| hCV11761245 | rs7043149 | hCV7442003 | rs884428 | 0.51 | 0.493197647 | 0.6742 |
| hCV11761245 | rs7043149 | hCV7442004 | rs884429 | 0.51 | 0.493197647 | 0.6742 |
| hCV11761245 | rs7043149 | hCV7442005 | rs1538584 | 0.51 | 0.493197647 | 1 |
| hCV11761245 | rs7043149 | hCV7482544 | rs1416738 | 0.51 | 0.493197647 | 0.6334 |
| hCV11761245 | rs7043149 | hDV70840481 | rs17062237 | 0.51 | 0.493197647 | 0.6712 |
| hCV11761245 | rs7043149 | hDV71162544 | rs1416739 | 0.51 | 0.493197647 | 0.6838 |
| hCV11761245 | rs7043149 | hDV81101901 | rs4745650 | 0.51 | 0.493197647 | 0.6798 |
| hCV11764545 | rs4961 | hCV15955503 | rs2237004 | 0.51 | 0.9 | 0.9709 |
| hCV11764545 | rs4961 | hCV15962694 | rs2285084 | 0.51 | 0.9 | 0.9715 |
| hCV11764545 | rs4961 | hCV16175508 | rs2239728 | 0.51 | 0.9 | 0.9715 |
| hCV11764545 | rs4961 | hCV7565684 | rs4964 | 0.51 | 0.9 | 0.9151 |
| hCV11764545 | rs4961 | hDV70681024 | rs16843523 | 0.51 | 0.9 | 0.9182 |
| hCV11846435 | rs6929299 | hCV103951 | rs6455688 | 0.51 | 0.312678096 | 0.8095 |
| hCV11846435 | rs6929299 | hCV103951 | rs6455688 | 0.51 | 0.350657214 | 0.8095 |
| hCV11846435 | rs6929299 | hCV103952 | rs6923877 | 0.51 | 0.312678096 | 0.8095 |
| hCV11846435 | rs6929299 | hCV103952 | rs6923877 | 0.51 | 0.350657214 | 0.8095 |
| hCV11846435 | rs6929299 | hCV11226249 | rs6415085 | 0.51 | 0.312678096 | 1 |
| hCV11846435 | rs6929299 | hCV11226249 | rs6415085 | 0.51 | 0.350657214 | 1 |
| hCV11846435 | rs6929299 | hCV11284288 | rs9457946 | 0.51 | 0.312678096 | 0.748 |
| hCV11846435 | rs6929299 | hCV11284288 | rs9457946 | 0.51 | 0.350657214 | 0.748 |
| hCV11846435 | rs6929299 | hCV11285578 | rs6926458 | 0.51 | 0.312678096 | 0.5122 |
| hCV11846435 | rs6929299 | hCV11285578 | rs6926458 | 0.51 | 0.350657214 | 0.5122 |
| hCV11846435 | rs6929299 | hCV11326233 | rs1950562 | 0.51 | 0.312678096 | 0.5177 |
| hCV11846435 | rs6929299 | hCV11326233 | rs1950562 | 0.51 | 0.350657214 | 0.5177 |
| hCV11846435 | rs6929299 | hCV1550866 | rs6932014 | 0.51 | 0.312678096 | 1 |
| hCV11846435 | rs6929299 | hCV1550866 | rs6932014 | 0.51 | 0.350657214 | 1 |
| hCV11846435 | rs6929299 | hCV1550871 | rs9355295 | 0.51 | 0.312678096 | 0.7601 |
| hCV11846435 | rs6929299 | hCV1550871 | rs9355295 | 0.51 | 0.350657214 | 0.7601 |
| hCV11846435 | rs6929299 | hCV16074739 | rs2144723 | 0.51 | 0.312678096 | 0.3144 |
| hCV11846435 | rs6929299 | hCV207123 | rs7771801 | 0.51 | 0.312678096 | 0.7556 |
| hCV11846435 | rs6929299 | hCV207123 | rs7771801 | 0.51 | 0.350657214 | 0.7556 |
| hCV11846435 | rs6929299 | hCV207127 | rs7453899 | 0.51 | 0.312678096 | 0.8123 |
| hCV11846435 | rs6929299 | hCV207127 | rs7453899 | 0.51 | 0.350657214 | 0.8123 |
| hCV11846435 | rs6929299 | hCV207128 | rs6455689 | 0.51 | 0.312678096 | 0.7581 |
| hCV11846435 | rs6929299 | hCV207128 | rs6455689 | 0.51 | 0.350657214 | 0.7581 |
| hCV11846435 | rs6929299 | hCV243055 | rs10945682 | 0.51 | 0.312678096 | 1 |
| hCV11846435 | rs6929299 | hCV243055 | rs10945682 | 0.51 | 0.350657214 | 1 |
| hCV11846435 | rs6929299 | hCV249895 | rs7771129 | 0.51 | 0.312678096 | 1 |
| hCV11846435 | rs6929299 | hCV249895 | rs7771129 | 0.51 | 0.350657214 | 1 |
| hCV11846435 | rs6929299 | hCV249897 | rs6913833 | 0.51 | 0.312678096 | 0.9266 |
| hCV11846435 | rs6929299 | hCV249897 | rs6913833 | 0.51 | 0.350657214 | 0.9266 |
| hCV11846435 | rs6929299 | hCV249898 | rs9456552 | 0.51 | 0.312678096 | 1 |
| hCV11846435 | rs6929299 | hCV249898 | rs9456552 | 0.51 | 0.350657214 | 1 |
| hCV11846435 | rs6929299 | hCV25927459 | rs3798221 | 0.51 | 0.312678096 | 0.3835 |
| hCV11846435 | rs6929299 | hCV25927459 | rs3798221 | 0.51 | 0.350657214 | 0.3835 |
| hCV11846435 | rs6929299 | hCV25929408 | rs7765781 | 0.51 | 0.312678096 | 0.7601 |
| hCV11846435 | rs6929299 | hCV25929408 | rs7765781 | 0.51 | 0.350657214 | 0.7601 |
| hCV11846435 | rs6929299 | hCV25929478 | rs7765803 | 0.51 | 0.312678096 | 0.8123 |
| hCV11846435 | rs6929299 | hCV25929478 | rs7765803 | 0.51 | 0.350657214 | 0.8123 |
| hCV11846435 | rs6929299 | hCV26272388 | rs7770685 | 0.51 | 0.312678096 | 0.5165 |
| hCV11846435 | rs6929299 | hCV26272388 | rs7770685 | 0.51 | 0.350657214 | 0.5165 |
| hCV11846435 | rs6929299 | hCV26272389 | rs7760585 | 0.51 | 0.312678096 | 1 |
| hCV11846435 | rs6929299 | hCV26272389 | rs7760585 | 0.51 | 0.350657214 | 1 |
| hCV11846435 | rs6929299 | hCV27422538 | rs6940254 | 0.51 | 0.312678096 | 0.5349 |
| hCV11846435 | rs6929299 | hCV27422538 | rs6940254 | 0.51 | 0.350657214 | 0.5349 |
| hCV11846435 | rs6929299 | hCV27422546 | rs7761377 | 0.51 | 0.312678096 | 0.9616 |
| hCV11846435 | rs6929299 | hCV27422546 | rs7761377 | 0.51 | 0.350657214 | 0.9616 |
| hCV11846435 | rs6929299 | hCV27422547 | rs6455696 | 0.51 | 0.312678096 | 0.9624 |
| hCV11846435 | rs6929299 | hCV27422547 | rs6455696 | 0.51 | 0.350657214 | 0.9624 |
| hCV11846435 | rs6929299 | hCV27422554 | rs6923917 | 0.51 | 0.312678096 | 1 |
| hCV11846435 | rs6929299 | hCV27422554 | rs6923917 | 0.51 | 0.350657214 | 1 |
| hCV11846435 | rs6929299 | hCV27422556 | rs9355814 | 0.51 | 0.312678096 | 0.9613 |
| hCV11846435 | rs6929299 | hCV27422556 | rs9355814 | 0.51 | 0.350657214 | 0.9613 |
| hCV11846435 | rs6929299 | hCV27422557 | rs9355813 | 0.51 | 0.312678096 | 0.9587 |
| hCV11846435 | rs6929299 | hCV27422557 | rs9355813 | 0.51 | 0.350657214 | 0.9587 |
| hCV11846435 | rs6929299 | hCV27422565 | rs13202636 | 0.51 | 0.312678096 | 0.5165 |
| hCV11846435 | rs6929299 | hCV27422565 | rs13202636 | 0.51 | 0.350657214 | 0.5165 |
| hCV11846435 | rs6929299 | hCV27422575 | rs6415084 | 0.51 | 0.312678096 | 0.353 |
| hCV11846435 | rs6929299 | hCV27422575 | rs6415084 | 0.51 | 0.350657214 | 0.353 |
| hCV11846435 | rs6929299 | hCV27436141 | rs9458005 | 0.51 | 0.312678096 | 0.3354 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV11846435 | rs6929299 | hCV29322781 | rs6921516 | 0.51 | 0.312678096 | 0.8326 |
| hCV11846435 | rs6929299 | hCV29322781 | rs6921516 | 0.51 | 0.350657214 | 0.8326 |
| hCV11846435 | rs6929299 | hCV29429528 | rs7772437 | 0.51 | 0.312678096 | 0.3127 |
| hCV11846435 | rs6929299 | hCV29546641 | rs9365171 | 0.51 | 0.312678096 | 0.7193 |
| hCV11846435 | rs6929299 | hCV29546641 | rs9365171 | 0.51 | 0.350657214 | 0.7193 |
| hCV11846435 | rs6929299 | hCV29609400 | rs9365200 | 0.51 | 0.312678096 | 0.3179 |
| hCV11846435 | rs6929299 | hCV29709361 | rs9365179 | 0.51 | 0.312678096 | 0.9803 |
| hCV11846435 | rs6929299 | hCV29709361 | rs9365179 | 0.51 | 0.350657214 | 0.9803 |
| hCV11846435 | rs6929299 | hCV29817515 | rs9355817 | 0.51 | 0.312678096 | 0.8881 |
| hCV11846435 | rs6929299 | hCV29817515 | rs9355817 | 0.51 | 0.350657214 | 0.8881 |
| hCV11846435 | rs6929299 | hCV29934611 | rs9295130 | 0.51 | 0.312678096 | 0.9801 |
| hCV11846435 | rs6929299 | hCV29934611 | rs9295130 | 0.51 | 0.350657214 | 0.9801 |
| hCV11846435 | rs6929299 | hCV29998162 | rs9457943 | 0.51 | 0.312678096 | 0.7601 |
| hCV11846435 | rs6929299 | hCV29998162 | rs9457943 | 0.51 | 0.350657214 | 0.7601 |
| hCV11846435 | rs6929299 | hCV30182157 | rs7767705 | 0.51 | 0.312678096 | 0.3354 |
| hCV11846435 | rs6929299 | hCV30385112 | rs9365201 | 0.51 | 0.312678096 | 0.3179 |
| hCV11846435 | rs6929299 | hCV305046 | rs6902102 | 0.51 | 0.312678096 | 1 |
| hCV11846435 | rs6929299 | hCV305046 | rs6902102 | 0.51 | 0.350657214 | 1 |
| hCV11846435 | rs6929299 | hCV30574599 | rs7770628 | 0.51 | 0.312678096 | 0.5719 |
| hCV11846435 | rs6929299 | hCV30574599 | rs7770628 | 0.51 | 0.350657214 | 0.5719 |
| hCV11846435 | rs6929299 | hCV31882494 | rs12175867 | 0.51 | 0.312678096 | 0.5349 |
| hCV11846435 | rs6929299 | hCV31882494 | rs12175867 | 0.51 | 0.350657214 | 0.5349 |
| hCV11846435 | rs6929299 | hCV3201490 | rs1321195 | 0.51 | 0.312678096 | 0.3278 |
| hCV11846435 | rs6929299 | hCV3201494 | rs1367209 | 0.51 | 0.312678096 | 0.6707 |
| hCV11846435 | rs6929299 | hCV3201494 | rs1367209 | 0.51 | 0.350657214 | 0.6707 |
| hCV11846435 | rs6929299 | hCV3201497 | rs1321196 | 0.51 | 0.312678096 | 1 |
| hCV11846435 | rs6929299 | hCV3201497 | rs1321196 | 0.51 | 0.350657214 | 1 |
| hCV11846435 | rs6929299 | hCV32404294 | rs4252065 | 0.51 | 0.312678096 | 0.506 |
| hCV11846435 | rs6929299 | hCV32404294 | rs4252065 | 0.51 | 0.350657214 | 0.506 |
| hCV11846435 | rs6929299 | hCV8701273 | rs783148 | 0.51 | 0.312678096 | 0.3278 |
| hCV11846435 | rs6929299 | hCV8710154 | rs1569933 | 0.51 | 0.312678096 | 1 |
| hCV11846435 | rs6929299 | hCV8710154 | rs1569933 | 0.51 | 0.350657214 | 1 |
| hCV11846435 | rs6929299 | hCV8710161 | rs1740428 | 0.51 | 0.312678096 | 1 |
| hCV11846435 | rs6929299 | hCV8710161 | rs1740428 | 0.51 | 0.350657214 | 1 |
| hCV11846435 | rs6929299 | hCV8710162 | rs1367211 | 0.51 | 0.312678096 | 0.6707 |
| hCV11846435 | rs6929299 | hCV8710162 | rs1367211 | 0.51 | 0.350657214 | 0.6707 |
| hCV11846435 | rs6929299 | hDV77235995 | rs7746273 | 0.51 | 0.312678096 | 0.9257 |
| hCV11846435 | rs6929299 | hDV77235995 | rs7746273 | 0.51 | 0.350657214 | 0.9257 |
| hCV11864162 | rs1167998 | hCV11864156 | rs10889334 | 0.51 | 0.9 | 0.9583 |
| hCV11864162 | rs1167998 | hCV11865171 | rs11208004 | 0.51 | 0.9 | 0.9585 |
| hCV11864162 | rs1167998 | hCV11865185 | rs10789117 | 0.51 | 0.9 | 0.9791 |
| hCV11864162 | rs1167998 | hCV11865196 | rs7555577 | 0.51 | 0.9 | 0.919 |
| hCV11864162 | rs1167998 | hCV11865201 | rs10159255 | 0.51 | 0.9 | 0.9376 |
| hCV11864162 | rs1167998 | hCV12103105 | rs1184865 | 0.51 | 0.9 | 1 |
| hCV11864162 | rs1167998 | hCV12103127 | rs1979722 | 0.51 | 0.9 | 0.9373 |
| hCV11864162 | rs1167998 | hCV12103499 | rs2029763 | 0.51 | 0.9 | 0.9558 |
| hCV11864162 | rs1167998 | hCV12103502 | rs1168023 | 0.51 | 0.9 | 1 |
| hCV11864162 | rs1167998 | hCV1236535 | rs1168042 | 0.51 | 0.9 | 1 |
| hCV11864162 | rs1167998 | hCV149783 | rs1168045 | 0.51 | 0.9 | 0.9791 |
| hCV11864162 | rs1167998 | hCV16214290 | rs2366638 | 0.51 | 0.9 | 1 |
| hCV11864162 | rs1167998 | hCV1778957 | rs3913007 | 0.51 | 0.9 | 0.9585 |
| hCV11864162 | rs1167998 | hCV1778958 | rs634341 | 0.51 | 0.9 | 1 |
| hCV11864162 | rs1167998 | hCV1778961 | rs630144 | 0.51 | 0.9 | 0.9164 |
| hCV11864162 | rs1167998 | hCV1778963 | rs10158897 | 0.51 | 0.9 | 0.9376 |
| hCV11864162 | rs1167998 | hCV1778964 | rs659656 | 0.51 | 0.9 | 0.959 |
| hCV11864162 | rs1167998 | hCV1778965 | rs637723 | 0.51 | 0.9 | 0.9583 |
| hCV11864162 | rs1167998 | hCV1918028 | rs10157265 | 0.51 | 0.9 | 1 |
| hCV11864162 | rs1167998 | hCV1918041 | rs4587594 | 0.51 | 0.9 | 0.9585 |
| hCV11864162 | rs1167998 | hCV1918054 | rs10889347 | 0.51 | 0.9 | 0.9791 |
| hCV11864162 | rs1167998 | hCV25971202 | rs10889335 | 0.51 | 0.9 | 0.9583 |
| hCV11864162 | rs1167998 | hCV26412183 | rs1748199 | 0.51 | 0.9 | 0.9585 |
| hCV11864162 | rs1167998 | hCV26412184 | rs11207990 | 0.51 | 0.9 | 1 |
| hCV11864162 | rs1167998 | hCV27320451 | rs4350231 | 0.51 | 0.9 | 0.9791 |
| hCV11864162 | rs1167998 | hCV27320465 | rs641540 | 0.51 | 0.9 | 1 |
| hCV11864162 | rs1167998 | hCV29103721 | rs6678483 | 0.51 | 0.9 | 0.9791 |
| hCV11864162 | rs1167998 | hCV29103722 | rs6675401 | 0.51 | 0.9 | 0.9791 |
| hCV11864162 | rs1167998 | hCV29103723 | rs4329540 | 0.51 | 0.9 | 0.9791 |
| hCV11864162 | rs1167998 | hCV29647381 | rs6690733 | 0.51 | 0.9 | 0.9583 |
| hCV11864162 | rs1167998 | hCV29749081 | rs10493322 | 0.51 | 0.9 | 0.959 |
| hCV11864162 | rs1167998 | hCV30224093 | rs7539035 | 0.51 | 0.9 | 0.9791 |
| hCV11864162 | rs1167998 | hCV31145250 | rs10889353 | 0.51 | 0.9 | 0.9585 |
| hCV11864162 | rs1167998 | hCV31145255 | rs11208000 | 0.51 | 0.9 | 0.956 |
| hCV11864162 | rs1167998 | hCV31145262 | rs10889352 | 0.51 | 0.9 | 0.9539 |
| hCV11864162 | rs1167998 | hCV31145264 | rs10789119 | 0.51 | 0.9 | 0.9585 |
| hCV11864162 | rs1167998 | hCV31145266 | rs10789118 | 0.51 | 0.9 | 0.959 |
| hCV11864162 | rs1167998 | hCV31145267 | rs11485618 | 0.51 | 0.9 | 0.9576 |
| hCV11864162 | rs1167998 | hCV31145269 | rs6587980 | 0.51 | 0.9 | 0.9791 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV11864162 | rs1167998 | hCV31145277 | rs10889350 | 0.51 | 0.9 | 1 |
| hCV11864162 | rs1167998 | hCV31145279 | rs10889349 | 0.51 | 0.9 | 1 |
| hCV11864162 | rs1167998 | hCV31145282 | rs11207997 | 0.51 | 0.9 | 0.9169 |
| hCV11864162 | rs1167998 | hCV31145290 | rs12042319 | 0.51 | 0.9 | 0.959 |
| hCV11864162 | rs1167998 | hCV31145291 | rs11207995 | 0.51 | 0.9 | 0.9373 |
| hCV11864162 | rs1167998 | hCV31145298 | rs11207992 | 0.51 | 0.9 | 0.959 |
| hCV11864162 | rs1167998 | hCV31145302 | rs12116574 | 0.51 | 0.9 | 0.9585 |
| hCV11864162 | rs1167998 | hCV31145332 | rs11207981 | 0.51 | 0.9 | 1 |
| hCV11864162 | rs1167998 | hCV3122390 | rs1748200 | 0.51 | 0.9 | 1 |
| hCV11864162 | rs1167998 | hCV316299 | rs1168026 | 0.51 | 0.9 | 1 |
| hCV11864162 | rs1167998 | hCV316303 | rs1168031 | 0.51 | 0.9 | 1 |
| hCV11864162 | rs1167998 | hCV32220452 | rs12090886 | 0.51 | 0.9 | 1 |
| hCV11864162 | rs1167998 | hCV32220453 | rs10889337 | 0.51 | 0.9 | 1 |
| hCV11864162 | rs1167998 | hCV32220467 | rs10889333 | 0.51 | 0.9 | 0.9585 |
| hCV11864162 | rs1167998 | hCV32220469 | rs10889332 | 0.51 | 0.9 | 0.9791 |
| hCV11864162 | rs1167998 | hCV32220470 | rs11207974 | 0.51 | 0.9 | 1 |
| hCV11864162 | rs1167998 | hCV32220491 | rs11577840 | 0.51 | 0.9 | 1 |
| hCV11864162 | rs1167998 | hCV32220495 | rs11207969 | 0.51 | 0.9 | 0.9791 |
| hCV11864162 | rs1167998 | hCV408090 | rs1183260 | 0.51 | 0.9 | 1 |
| hCV11864162 | rs1167998 | hCV445207 | rs1627591 | 0.51 | 0.9 | 1 |
| hCV11864162 | rs1167998 | hCV71419 | rs2131925 | 0.51 | 0.9 | 1 |
| hCV11864162 | rs1167998 | hCV857102 | rs624660 | 0.51 | 0.9 | 0.9791 |
| hCV11864162 | rs1167998 | hCV857103 | rs636497 | 0.51 | 0.9 | 0.9585 |
| hCV11864162 | rs1167998 | hCV857104 | rs636523 | 0.51 | 0.9 | 0.959 |
| hCV11864162 | rs1167998 | hCV857108 | rs597078 | 0.51 | 0.9 | 1 |
| hCV11864162 | rs1167998 | hCV857109 | rs597470 | 0.51 | 0.9 | 1 |
| hCV11864162 | rs1167998 | hCV857110 | rs583609 | 0.51 | 0.9 | 0.9791 |
| hCV11864162 | rs1167998 | hCV857121 | rs642845 | 0.51 | 0.9 | 1 |
| hCV11864162 | rs1167998 | hCV857122 | rs656297 | 0.51 | 0.9 | 0.9791 |
| hCV11864162 | rs1167998 | hCV857123 | rs638305 | 0.51 | 0.9 | 1 |
| hCV11864162 | rs1167998 | hCV857127 | rs631106 | 0.51 | 0.9 | 0.9585 |
| hCV11864162 | rs1167998 | hCV9508668 | rs1781195 | 0.51 | 0.9 | 0.9791 |
| hCV11864162 | rs1167998 | hCV9581062 | rs998403 | 0.51 | 0.9 | 0.958 |
| hCV11864162 | rs1167998 | hCV9581551 | rs1168040 | 0.51 | 0.9 | 0.9364 |
| hCV11864162 | rs1167998 | hCV9581570 | rs1168036 | 0.51 | 0.9 | 1 |
| hCV11864162 | rs1167998 | hCV9581571 | rs1002687 | 0.51 | 0.9 | 1 |
| hCV11864162 | rs1167998 | hCV9581580 | rs1168032 | 0.51 | 0.9 | 1 |
| hCV11864162 | rs1167998 | hCV9581581 | rs1168030 | 0.51 | 0.9 | 1 |
| hCV11864162 | rs1167998 | hCV9581590 | rs1168018 | 0.51 | 0.9 | 0.979 |
| hCV11864162 | rs1167998 | hCV9581606 | rs1168022 | 0.51 | 0.9 | 1 |
| hCV11864162 | rs1167998 | hCV9581615 | rs1748201 | 0.51 | 0.9 | 0.979 |
| hCV11864162 | rs1167998 | hCV9581635 | rs1748195 | 0.51 | 0.9 | 0.9791 |
| hCV11864162 | rs1167998 | hCV9581636 | rs3850634 | 0.51 | 0.9 | 0.9585 |
| hCV11864162 | rs1167998 | hCV9581680 | rs1748197 | 0.51 | 0.9 | 1 |
| hCV11864162 | rs1167998 | hCV9581691 | rs1570694 | 0.51 | 0.9 | 0.9585 |
| hCV11864162 | rs1167998 | hCV9583244 | rs783291 | 0.51 | 0.9 | 1 |
| hCV11864162 | rs1167998 | hCV9588770 | rs1007205 | 0.51 | 0.9 | 1 |
| hCV11864162 | rs1167998 | hCV9588793 | rs1168009 | 0.51 | 0.9 | 0.9789 |
| hCV11864162 | rs1167998 | hCV9588794 | rs1168010 | 0.51 | 0.9 | 0.9787 |
| hCV11864162 | rs1167998 | hCV9588829 | rs1781212 | 0.51 | 0.9 | 1 |
| hCV11864162 | rs1167998 | hCV9588850 | rs1168013 | 0.51 | 0.9 | 0.9791 |
| hCV11864162 | rs1167998 | hCV9588862 | rs995000 | 0.51 | 0.9 | 0.9585 |
| hCV11864162 | rs1167998 | hCV9588875 | rs1168086 | 0.51 | 0.9 | 0.9551 |
| hCV11864162 | rs1167998 | hCV9588886 | rs1168089 | 0.51 | 0.9 | 0.9791 |
| hCV11864162 | rs1167998 | hCV9588930 | rs1168099 | 0.51 | 0.9 | 0.9791 |
| hCV11864162 | rs1167998 | hCV9588985 | rs1168124 | 0.51 | 0.9 | 1 |
| hCV11864162 | rs1167998 | hDV75176134 | rs1781221 | 0.51 | 0.9 | 1 |
| hCV1188731 | rs4908514 | hCV1188735 | rs10864366 | 0.51 | 0.902764173 | 1 |
| hCV1188731 | rs4908514 | hCV27157507 | rs6664000 | 0.51 | 0.902764173 | 1 |
| hCV1188731 | rs4908514 | hCV27157524 | rs6577531 | 0.51 | 0.902764173 | 0.9353 |
| hCV1188731 | rs4908514 | hCV27884601 | rs4908776 | 0.51 | 0.902764173 | 1 |
| hCV1188731 | rs4908514 | hCV28023091 | rs4908773 | 0.51 | 0.902764173 | 1 |
| hCV1188731 | rs4908514 | hCV29368919 | rs4908513 | 0.51 | 0.902764173 | 1 |
| hCV1188731 | rs4908514 | hCV29873524 | rs7533113 | 0.51 | 0.902764173 | 1 |
| hCV1188731 | rs4908514 | hCV29945430 | rs7517436 | 0.51 | 0.902764173 | 1 |
| hCV1188731 | rs4908514 | hCV30035535 | rs7518204 | 0.51 | 0.902764173 | 1 |
| hCV1188731 | rs4908514 | hCV32055527 | rs10864364 | 0.51 | 0.902764173 | 1 |
| hCV1188731 | rs4908514 | hCV32055579 | rs6577522 | 0.51 | 0.902764173 | 1 |
| hCV1188731 | rs4908514 | hCV32055595 | rs6577524 | 0.51 | 0.902764173 | 1 |
| hCV1188731 | rs4908514 | hCV32055596 | rs6577525 | 0.51 | 0.902764173 | 1 |
| hCV1188731 | rs4908514 | hCV32055637 | rs6577532 | 0.51 | 0.902764173 | 0.9314 |
| hCV1188731 | rs4908514 | hCV8823713 | rs1472228 | 0.51 | 0.902764173 | 1 |
| hCV1188735 | rs10864366 | hCV1188731 | rs4908514 | 0.51 | 0.900202572 | 1 |
| hCV1188735 | rs10864366 | hCV27157507 | rs6664000 | 0.51 | 0.900202572 | 1 |
| hCV1188735 | rs10864366 | hCV27157524 | rs6577531 | 0.51 | 0.900202572 | 0.9314 |
| hCV1188735 | rs10864366 | hCV27884601 | rs4908776 | 0.51 | 0.900202572 | 1 |
| hCV1188735 | rs10864366 | hCV28023091 | rs4908773 | 0.51 | 0.900202572 | 1 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV1188735 | rs10864366 | hCV29368919 | rs4908513 | 0.51 | 0.900202572 | 1 |
| hCV1188735 | rs10864366 | hCV29873524 | rs7533113 | 0.51 | 0.900202572 | 1 |
| hCV1188735 | rs10864366 | hCV29945430 | rs7517436 | 0.51 | 0.900202572 | 1 |
| hCV1188735 | rs10864366 | hCV30035535 | rs7518204 | 0.51 | 0.900202572 | 1 |
| hCV1188735 | rs10864366 | hCV32055527 | rs10864364 | 0.51 | 0.900202572 | 1 |
| hCV1188735 | rs10864366 | hCV32055579 | rs6577522 | 0.51 | 0.900202572 | 1 |
| hCV1188735 | rs10864366 | hCV32055595 | rs6577524 | 0.51 | 0.900202572 | 1 |
| hCV1188735 | rs10864366 | hCV32055596 | rs6577525 | 0.51 | 0.900202572 | 1 |
| hCV1188735 | rs10864366 | hCV8823713 | rs1472228 | 0.51 | 0.900202572 | 1 |
| hCV1188747 | rs4908511 | hCV11398047 | rs1922983 | 0.51 | 0.490752814 | 0.5859 |
| hCV1188747 | rs4908511 | hCV11398445 | rs1934138 | 0.51 | 0.490752814 | 0.6427 |
| hCV1188747 | rs4908511 | hCV11675339 | rs7530745 | 0.51 | 0.490752814 | 0.574 |
| hCV1188747 | rs4908511 | hCV11675361 | rs301819 | 0.51 | 0.490752814 | 0.495 |
| hCV1188747 | rs4908511 | hCV11675982 | rs1953827 | 0.51 | 0.490752814 | 0.589 |
| hCV1188747 | rs4908511 | hCV11675985 | rs12136766 | 0.51 | 0.490752814 | 0.589 |
| hCV1188747 | rs4908511 | hCV1188706 | rs2185205 | 0.51 | 0.490752814 | 0.8148 |
| hCV1188747 | rs4908511 | hCV1188726 | rs6698830 | 0.51 | 0.490752814 | 0.8871 |
| hCV1188747 | rs4908511 | hCV1188748 | rs12028160 | 0.51 | 0.490752814 | 0.9804 |
| hCV1188747 | rs4908511 | hCV1265820 | rs6577488 | 0.51 | 0.490752814 | 0.5859 |
| hCV1188747 | rs4908511 | hCV1265823 | rs1024197 | 0.51 | 0.490752814 | 0.574 |
| hCV1188747 | rs4908511 | hCV1265830 | rs7551849 | 0.51 | 0.490752814 | 0.574 |
| hCV1188747 | rs4908511 | hCV1265841 | rs10864354 | 0.51 | 0.490752814 | 0.5424 |
| hCV1188747 | rs4908511 | hCV1265857 | rs10864356 | 0.51 | 0.490752814 | 0.574 |
| hCV1188747 | rs4908511 | hCV1265858 | rs11121194 | 0.51 | 0.490752814 | 0.6093 |
| hCV1188747 | rs4908511 | hCV1265860 | rs6577491 | 0.51 | 0.490752814 | 0.5859 |
| hCV1188747 | rs4908511 | hCV1265866 | rs6577496 | 0.51 | 0.490752814 | 0.5763 |
| hCV1188747 | rs4908511 | hCV16007535 | rs2401138 | 0.51 | 0.490752814 | 0.6433 |
| hCV1188747 | rs4908511 | hCV27157433 | rs7544052 | 0.51 | 0.490752814 | 0.5193 |
| hCV1188747 | rs4908511 | hCV27157435 | rs7513420 | 0.51 | 0.490752814 | 0.5424 |
| hCV1188747 | rs4908511 | hCV27157439 | rs10779704 | 0.51 | 0.490752814 | 0.5331 |
| hCV1188747 | rs4908511 | hCV27157529 | rs1463049 | 0.51 | 0.490752814 | 0.6521 |
| hCV1188747 | rs4908511 | hCV27157851 | rs4480384 | 0.51 | 0.490752814 | 0.6203 |
| hCV1188747 | rs4908511 | hCV27506877 | rs3938719 | 0.51 | 0.490752814 | 0.4909 |
| hCV1188747 | rs4908511 | hCV27979869 | rs4908760 | 0.51 | 0.490752814 | 0.5693 |
| hCV1188747 | rs4908511 | hCV29368911 | rs6577513 | 0.51 | 0.490752814 | 0.6112 |
| hCV1188747 | rs4908511 | hCV29368927 | rs6577499 | 0.51 | 0.490752814 | 0.5859 |
| hCV1188747 | rs4908511 | hCV29368929 | rs6577502 | 0.51 | 0.490752814 | 0.574 |
| hCV1188747 | rs4908511 | hCV29674579 | rs7542312 | 0.51 | 0.490752814 | 0.574 |
| hCV1188747 | rs4908511 | hCV29855298 | rs6690928 | 0.51 | 0.490752814 | 0.9259 |
| hCV1188747 | rs4908511 | hCV29981708 | rs7554486 | 0.51 | 0.490752814 | 0.8421 |
| hCV1188747 | rs4908511 | hCV30233466 | rs7513880 | 0.51 | 0.490752814 | 0.8871 |
| hCV1188747 | rs4908511 | hCV30287627 | rs6675443 | 0.51 | 0.490752814 | 0.6014 |
| hCV1188747 | rs4908511 | hCV30341660 | rs6681362 | 0.51 | 0.490752814 | 0.6064 |
| hCV1188747 | rs4908511 | hCV30413939 | rs6701331 | 0.51 | 0.490752814 | 0.589 |
| hCV1188747 | rs4908511 | hCV30413946 | rs7537982 | 0.51 | 0.490752814 | 0.6203 |
| hCV1188747 | rs4908511 | hCV3086941 | rs7556169 | 0.51 | 0.490752814 | 0.6368 |
| hCV1188747 | rs4908511 | hCV3086945 | rs6695867 | 0.51 | 0.490752814 | 0.6695 |
| hCV1188747 | rs4908511 | hCV3086948 | rs10864361 | 0.51 | 0.490752814 | 0.6532 |
| hCV1188747 | rs4908511 | hCV3086949 | rs11121212 | 0.51 | 0.490752814 | 0.7081 |
| hCV1188747 | rs4908511 | hCV3086952 | rs6577514 | 0.51 | 0.490752814 | 0.6232 |
| hCV1188747 | rs4908511 | hCV3086954 | rs1463053 | 0.51 | 0.490752814 | 0.6047 |
| hCV1188747 | rs4908511 | hCV3086956 | rs1463052 | 0.51 | 0.490752814 | 0.589 |
| hCV1188747 | rs4908511 | hCV3086959 | rs7520025 | 0.51 | 0.490752814 | 0.6689 |
| hCV1188747 | rs4908511 | hCV3086965 | rs1381928 | 0.51 | 0.490752814 | 0.6427 |
| hCV1188747 | rs4908511 | hCV3086974 | rs1318218 | 0.51 | 0.490752814 | 0.6354 |
| hCV1188747 | rs4908511 | hCV3086976 | rs11121204 | 0.51 | 0.490752814 | 0.5977 |
| hCV1188747 | rs4908511 | hCV3086978 | rs7526171 | 0.51 | 0.490752814 | 0.6419 |
| hCV1188747 | rs4908511 | hCV3086981 | rs6670508 | 0.51 | 0.490752814 | 0.6427 |
| hCV1188747 | rs4908511 | hCV3086985 | rs6663123 | 0.51 | 0.490752814 | 0.6427 |
| hCV1188747 | rs4908511 | hCV3086990 | rs11121202 | 0.51 | 0.490752814 | 0.6427 |
| hCV1188747 | rs4908511 | hCV3087002 | rs1473420 | 0.51 | 0.490752814 | 0.5859 |
| hCV1188747 | rs4908511 | hCV3087004 | rs2016084 | 0.51 | 0.490752814 | 0.4917 |
| hCV1188747 | rs4908511 | hCV3087005 | rs6702060 | 0.51 | 0.490752814 | 0.5703 |
| hCV1188747 | rs4908511 | hCV3087012 | rs1463051 | 0.51 | 0.490752814 | 0.5859 |
| hCV1188747 | rs4908511 | hCV32055336 | rs12080583 | 0.51 | 0.490752814 | 0.5794 |
| hCV1188747 | rs4908511 | hCV32055351 | rs12046643 | 0.51 | 0.490752814 | 0.5654 |
| hCV1188747 | rs4908511 | hCV32055354 | rs4908761 | 0.51 | 0.490752814 | 0.5823 |
| hCV1188747 | rs4908511 | hCV32055465 | rs6668508 | 0.51 | 0.490752814 | 0.5859 |
| hCV1188747 | rs4908511 | hCV32055479 | rs11121210 | 0.51 | 0.490752814 | 0.6118 |
| hCV1188747 | rs4908511 | hCV32055489 | rs10864360 | 0.51 | 0.490752814 | 0.7081 |
| hCV1188747 | rs4908511 | hCV32055490 | rs6669503 | 0.51 | 0.490752814 | 0.574 |
| hCV1188747 | rs4908511 | hCV32055496 | rs11121215 | 0.51 | 0.490752814 | 0.6433 |
| hCV1188747 | rs4908511 | hCV32055498 | rs4908507 | 0.51 | 0.490752814 | 0.6692 |
| hCV1188747 | rs4908511 | hCV32055554 | rs12024032 | 0.51 | 0.490752814 | 0.9804 |
| hCV1188747 | rs4908511 | hCV32055587 | rs10864367 | 0.51 | 0.490752814 | 0.8871 |
| hCV1188747 | rs4908511 | hCV32055588 | rs12131864 | 0.51 | 0.490752814 | 0.574 |
| hCV1188747 | rs4908511 | hCV32055630 | rs4908518 | 0.51 | 0.490752814 | 0.8148 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV1188747 | rs4908511 | hCV32056071 | rs11121201 | 0.51 | 0.490752814 | 0.574 |
| hCV1188747 | rs4908511 | hCV32392515 | rs4908505 | 0.51 | 0.490752814 | 0.6532 |
| hCV1188747 | rs4908511 | hCV597221 | rs301814 | 0.51 | 0.490752814 | 0.574 |
| hCV1188747 | rs4908511 | hCV8379452 | rs4908781 | 0.51 | 0.490752814 | 0.7134 |
| hCV1188747 | rs4908511 | hCV8881153 | rs1061039 | 0.51 | 0.490752814 | 0.6427 |
| hCV1188747 | rs4908511 | hDV75072264 | rs12403640 | 0.51 | 0.490752814 | 0.9612 |
| hCV1188747 | rs4908511 | hDV77058075 | rs4908506 | 0.51 | 0.490752814 | 0.6368 |
| hCV11955747 | rs9901673 | hCV247220 | rs6608 | 0.51 | 0.9 | 0.9705 |
| hCV11955747 | rs9901673 | hCV26603808 | rs4542712 | 0.51 | 0.9 | 1 |
| hCV11955747 | rs9901673 | hCV31413193 | rs10852891 | 0.51 | 0.9 | 1 |
| hCV11972326 | rs5988 | hCV11322865 | rs3024455 | 0.51 | 0.9 | 1 |
| hCV11972326 | rs5988 | hCV11322900 | rs3024458 | 0.51 | 0.9 | 1 |
| hCV11972326 | rs5988 | hCV11322912 | rs9504688 | 0.51 | 0.9 | 0.9502 |
| hCV11972326 | rs5988 | hCV11972327 | rs5980 | 0.51 | 0.9 | 1 |
| hCV11972326 | rs5988 | hCV15983503 | rs3024456 | 0.51 | 0.9 | 1 |
| hCV11972326 | rs5988 | hCV15983508 | rs2274394 | 0.51 | 0.9 | 1 |
| hCV11972326 | rs5988 | hCV1860557 | rs4960166 | 0.51 | 0.9 | 0.9527 |
| hCV11972326 | rs5988 | hCV1860558 | rs2170618 | 0.51 | 0.9 | 0.9505 |
| hCV11972326 | rs5988 | hCV1860559 | rs13211082 | 0.51 | 0.9 | 0.9505 |
| hCV11972326 | rs5988 | hCV1860560 | rs13203617 | 0.51 | 0.9 | 0.9527 |
| hCV11972326 | rs5988 | hCV1860561 | rs9504686 | 0.51 | 0.9 | 0.9527 |
| hCV11972326 | rs5988 | hCV1860567 | rs3799564 | 0.51 | 0.9 | 0.9505 |
| hCV11972326 | rs5988 | hCV1860574 | rs13203312 | 0.51 | 0.9 | 1 |
| hCV11972326 | rs5988 | hCV1860575 | rs6937073 | 0.51 | 0.9 | 1 |
| hCV11972326 | rs5988 | hCV1860576 | rs6914953 | 0.51 | 0.9 | 1 |
| hCV11972326 | rs5988 | hCV1860577 | rs6913691 | 0.51 | 0.9 | 1 |
| hCV11972326 | rs5988 | hCV1860580 | rs6899562 | 0.51 | 0.9 | 1 |
| hCV11972326 | rs5988 | hCV1860582 | rs35010441 | 0.51 | 0.9 | 1 |
| hCV11972326 | rs5988 | hCV1860590 | rs4960169 | 0.51 | 0.9 | 1 |
| hCV11972326 | rs5988 | hCV1860592 | rs6912528 | 0.51 | 0.9 | 1 |
| hCV11972326 | rs5988 | hCV27953512 | rs4282440 | 0.51 | 0.9 | 1 |
| hCV11972326 | rs5988 | hCV28018442 | rs4282441 | 0.51 | 0.9 | 1 |
| hCV11972326 | rs5988 | hCV29167515 | rs6936882 | 0.51 | 0.9 | 1 |
| hCV11972326 | rs5988 | hCV29167516 | rs6913645 | 0.51 | 0.9 | 1 |
| hCV11972326 | rs5988 | hCV29992410 | rs9502419 | 0.51 | 0.9 | 0.9512 |
| hCV11972326 | rs5988 | hCV30190386 | rs9504681 | 0.51 | 0.9 | 0.9021 |
| hCV11972326 | rs5988 | hCV30460540 | rs9504684 | 0.51 | 0.9 | 0.9496 |
| hCV11972326 | rs5988 | hCV31360336 | rs13194966 | 0.51 | 0.9 | 1 |
| hCV11972326 | rs5988 | hCV31360339 | rs4352723 | 0.51 | 0.9 | 1 |
| hCV11972326 | rs5988 | hCV31360343 | rs13203052 | 0.51 | 0.9 | 1 |
| hCV11972326 | rs5988 | hCV31360344 | rs4960170 | 0.51 | 0.9 | 1 |
| hCV11972326 | rs5988 | hCV31360346 | rs13220642 | 0.51 | 0.9 | 1 |
| hCV11972326 | rs5988 | hCV31360347 | rs13193648 | 0.51 | 0.9 | 1 |
| hCV11972326 | rs5988 | hCV31360444 | rs12181800 | 0.51 | 0.9 | 0.9527 |
| hCV11972326 | rs5988 | hDV77006766 | rs4463306 | 0.51 | 0.9 | 1 |
| hCV11972326 | rs5988 | hDV77023919 | rs4607478 | 0.51 | 0.9 | 1 |
| hCV12020339 | rs4531 | hCV31083062 | rs10993947 | 0.51 | 0.9 | 1 |
| hCV1243283 | rs1716 | hCV1022603 | rs220462 | 0.51 | 0.9 | 1 |
| hCV1243283 | rs1716 | hCV11679326 | rs2976234 | 0.51 | 0.9 | 0.9342 |
| hCV1243283 | rs1716 | hCV1243284 | rs2915555 | 0.51 | 0.9 | 1 |
| hCV1243283 | rs1716 | hCV3211391 | rs220461 | 0.51 | 0.9 | 0.9337 |
| hCV1253630 | rs2071307 | hCV1253631 | rs2239691 | 0.51 | 0.9 | 0.9801 |
| hCV1253630 | rs2071307 | hCV1253643 | rs868005 | 0.51 | 0.9 | 1 |
| hCV1253630 | rs2071307 | hCV1253666 | rs6971698 | 0.51 | 0.9 | 0.9259 |
| hCV1323634 | rs287475 | hCV1323632 | rs287479 | 0.51 | 0.9 | 1 |
| hCV1323634 | rs287475 | hCV1323635 | rs287474 | 0.51 | 0.9 | 1 |
| hCV1323634 | rs287475 | hCV1323659 | rs287360 | 0.51 | 0.9 | 0.9252 |
| hCV1323634 | rs287475 | hCV1323680 | rs12585011 | 0.51 | 0.9 | 0.9616 |
| hCV1323634 | rs287475 | hCV1323684 | rs287347 | 0.51 | 0.9 | 0.9616 |
| hCV1323634 | rs287475 | hCV1323696 | rs11842785 | 0.51 | 0.9 | 0.9608 |
| hCV1323634 | rs287475 | hCV1323700 | rs6562535 | 0.51 | 0.9 | 0.9567 |
| hCV1323634 | rs287475 | hCV1323701 | rs7330307 | 0.51 | 0.9 | 0.96 |
| hCV1323634 | rs287475 | hCV1323702 | rs7329795 | 0.51 | 0.9 | 0.96 |
| hCV1323634 | rs287475 | hCV32085644 | rs12585431 | 0.51 | 0.9 | 0.9616 |
| hCV1323634 | rs287475 | hCV32085645 | rs11842784 | 0.51 | 0.9 | 0.9608 |
| hCV1323634 | rs287475 | hCV615776 | rs287476 | 0.51 | 0.9 | 0.9166 |
| hCV1323634 | rs287475 | hCV615780 | rs287439 | 0.51 | 0.9 | 0.9166 |
| hCV1323669 | rs287354 | hCV1323632 | rs287479 | 0.51 | 0.9 | 0.9244 |
| hCV1323669 | rs287354 | hCV1323635 | rs287474 | 0.51 | 0.9 | 0.9244 |
| hCV1323669 | rs287354 | hCV1323659 | rs287360 | 0.51 | 0.9 | 0.9234 |
| hCV1323669 | rs287354 | hCV1323670 | rs167000 | 0.51 | 0.9 | 0.9407 |
| hCV1323669 | rs287354 | hCV1323673 | rs287352 | 0.51 | 0.9 | 0.98 |
| hCV1323669 | rs287354 | hCV1323678 | rs287350 | 0.51 | 0.9 | 0.9796 |
| hCV1323669 | rs287354 | hCV1323680 | rs12585011 | 0.51 | 0.9 | 0.9617 |
| hCV1323669 | rs287354 | hCV1323684 | rs287347 | 0.51 | 0.9 | 0.9617 |
| hCV1323669 | rs287354 | hCV1323686 | rs2039578 | 0.51 | 0.9 | 0.98 |
| hCV1323669 | rs287354 | hCV1323696 | rs11842785 | 0.51 | 0.9 | 0.9609 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV1323669 | rs287354 | hCV1323700 | rs6562535 | 0.51 | 0.9 | 0.9568 |
| hCV1323669 | rs287354 | hCV1323701 | rs7330307 | 0.51 | 0.9 | 0.96 |
| hCV1323669 | rs287354 | hCV1323702 | rs7329795 | 0.51 | 0.9 | 0.96 |
| hCV1323669 | rs287354 | hCV1323703 | rs17641312 | 0.51 | 0.9 | 0.9395 |
| hCV1323669 | rs287354 | hCV1323704 | rs8002457 | 0.51 | 0.9 | 0.9401 |
| hCV1323669 | rs287354 | hCV32085644 | rs12585431 | 0.51 | 0.9 | 0.9617 |
| hCV1323669 | rs287354 | hCV32085645 | rs11842784 | 0.51 | 0.9 | 0.9609 |
| hCV1323669 | rs287354 | hCV615776 | rs287476 | 0.51 | 0.9 | 0.9408 |
| hCV1323669 | rs287354 | hCV615780 | rs287439 | 0.51 | 0.9 | 0.9408 |
| hCV1323669 | rs287354 | hCV7597674 | rs287356 | 0.51 | 0.9 | 0.98 |
| hCV1345898 | rs2230804 | hCV11753633 | rs7923726 | 0.51 | 0.9 | 1 |
| hCV1345898 | rs2230804 | hCV1345851 | rs2270961 | 0.51 | 0.9 | 0.981 |
| hCV1345898 | rs2230804 | hCV1345862 | rs6584354 | 0.51 | 0.9 | 0.9619 |
| hCV1345898 | rs2230804 | hCV1345912 | rs7909855 | 0.51 | 0.9 | 0.9621 |
| hCV1345898 | rs2230804 | hCV1858698 | rs3818411 | 0.51 | 0.9 | 0.981 |
| hCV1345898 | rs2230804 | hCV25592811 | rs4919438 | 0.51 | 0.9 | 0.981 |
| hCV1345898 | rs2230804 | hCV29348491 | rs7922807 | 0.51 | 0.9 | 0.9619 |
| hCV1345898 | rs2230804 | hCV29348492 | rs7079072 | 0.51 | 0.9 | 0.9649 |
| hCV1345898 | rs2230804 | hCV31980317 | rs12254005 | 0.51 | 0.9 | 1 |
| hCV1345898 | rs2230804 | hCV31980340 | rs12242503 | 0.51 | 0.9 | 0.9619 |
| hCV1345898 | rs2230804 | hCV31980399 | rs12269373 | 0.51 | 0.9 | 0.981 |
| hCV1361979 | rs25683 | hCV11414348 | rs13202042 | 0.51 | 0.9 | 0.9812 |
| hCV1361979 | rs25683 | hCV1361961 | rs3818299 | 0.51 | 0.9 | 0.9812 |
| hCV1361979 | rs25683 | hCV1361978 | rs11751480 | 0.51 | 0.9 | 0.9621 |
| hCV1361979 | rs25683 | hCV1361983 | rs13194896 | 0.51 | 0.9 | 1 |
| hCV1361979 | rs25683 | hCV1361988 | rs3798211 | 0.51 | 0.9 | 0.9628 |
| hCV1361979 | rs25683 | hCV1362003 | rs1440 | 0.51 | 0.9 | 0.9812 |
| hCV1361979 | rs25683 | hCV15818677 | rs2842970 | 0.51 | 0.9 | 0.9648 |
| hCV1361979 | rs25683 | hCV15818688 | rs2842975 | 0.51 | 0.9 | 0.9648 |
| hCV1361979 | rs25683 | hCV15818690 | rs2842972 | 0.51 | 0.9 | 0.9807 |
| hCV1361979 | rs25683 | hCV16179956 | rs2273828 | 0.51 | 0.9 | 0.9812 |
| hCV1361979 | rs25683 | hCV16191216 | rs2295899 | 0.51 | 0.9 | 0.9812 |
| hCV1361979 | rs25683 | hCV16288760 | rs2758311 | 0.51 | 0.9 | 0.9635 |
| hCV1361979 | rs25683 | hCV8699839 | rs927450 | 0.51 | 0.9 | 0.9812 |
| hCV1375141 | rs1881420 | hCV11167501 | rs12619135 | 0.51 | 0.9 | 1 |
| hCV1375141 | rs1881420 | hCV1375138 | rs13428329 | 0.51 | 0.9 | 1 |
| hCV1375141 | rs1881420 | hCV1375139 | rs4666172 | 0.51 | 0.9 | 0.9054 |
| hCV1375141 | rs1881420 | hCV1375144 | rs2278879 | 0.51 | 0.9 | 1 |
| hCV1375141 | rs1881420 | hCV27505984 | rs3820712 | 0.51 | 0.9 | 0.9054 |
| hCV1375141 | rs1881420 | hCV27513883 | rs3768672 | 0.51 | 0.9 | 1 |
| hCV1375141 | rs1881420 | hCV30109305 | rs4666176 | 0.51 | 0.9 | 0.9054 |
| hCV1375141 | rs1881420 | hCV32191953 | rs13386033 | 0.51 | 0.9 | 0.9124 |
| hCV1375141 | rs1881420 | hCV9531551 | rs1026277 | 0.51 | 0.9 | 1 |
| hCV1463112 | rs3763608 | hCV11765753 | rs3793456 | 0.51 | 0.763750033 | 0.827 |
| hCV1463112 | rs3763608 | hCV1463244 | rs3793465 | 0.51 | 0.763750033 | 0.8333 |
| hCV1463112 | rs3763608 | hCV1463252 | rs3793461 | 0.51 | 0.763750033 | 0.8591 |
| hCV1463112 | rs3763608 | hCV15761059 | rs2309393 | 0.51 | 0.763750033 | 0.8333 |
| hCV1463112 | rs3763608 | hCV26566199 | rs3793467 | 0.51 | 0.763750033 | 0.8591 |
| hCV1463112 | rs3763608 | hCV28008078 | rs4745543 | 0.51 | 0.763750033 | 1 |
| hCV1463112 | rs3763608 | hCV30586985 | rs10126006 | 0.51 | 0.763750033 | 0.8497 |
| hCV1463112 | rs3763608 | hCV31363797 | rs11145043 | 0.51 | 0.763750033 | 0.7954 |
| hCV1463112 | rs3763608 | hCV31363840 | rs7875693 | 0.51 | 0.763750033 | 0.7758 |
| hCV1463112 | rs3763608 | hCV31363841 | rs7849347 | 0.51 | 0.763750033 | 0.792 |
| hCV1463222 | rs4744808 | hCV11373123 | rs1984003 | 0.51 | 0.343783224 | 1 |
| hCV1463222 | rs4744808 | hCV11761245 | rs7043149 | 0.51 | 0.343783224 | 0.3997 |
| hCV1463222 | rs4744808 | hCV11765727 | rs10781379 | 0.51 | 0.343783224 | 1 |
| hCV1463222 | rs4744808 | hCV11765729 | rs7875659 | 0.51 | 0.343783224 | 1 |
| hCV1463222 | rs4744808 | hCV11765753 | rs3793456 | 0.51 | 0.343783224 | 0.7223 |
| hCV1463222 | rs4744808 | hCV1463101 | rs7871596 | 0.51 | 0.343783224 | 0.4845 |
| hCV1463222 | rs4744808 | hCV1463112 | rs3763608 | 0.51 | 0.343783224 | 0.5342 |
| hCV1463222 | rs4744808 | hCV1463185 | rs953588 | 0.51 | 0.343783224 | 0.5193 |
| hCV1463222 | rs4744808 | hCV1463197 | rs6560551 | 0.51 | 0.343783224 | 0.7657 |
| hCV1463222 | rs4744808 | hCV1463216 | rs4745581 | 0.51 | 0.343783224 | 1 |
| hCV1463222 | rs4744808 | hCV1463217 | rs4745580 | 0.51 | 0.343783224 | 0.7657 |
| hCV1463222 | rs4744808 | hCV1463218 | rs1984004 | 0.51 | 0.343783224 | 1 |
| hCV1463222 | rs4744808 | hCV1463223 | rs4744807 | 0.51 | 0.343783224 | 0.7609 |
| hCV1463222 | rs4744808 | hCV1463225 | rs4745577 | 0.51 | 0.343783224 | 1 |
| hCV1463222 | rs4744808 | hCV1463226 | rs10890 | 0.51 | 0.343783224 | 1 |
| hCV1463222 | rs4744808 | hCV1463229 | rs7861997 | 0.51 | 0.343783224 | 0.7996 |
| hCV1463222 | rs4744808 | hCV1463231 | rs7870295 | 0.51 | 0.343783224 | 0.7657 |
| hCV1463222 | rs4744808 | hCV1463232 | rs9314854 | 0.51 | 0.343783224 | 1 |
| hCV1463222 | rs4744808 | hCV1463235 | rs2498430 | 0.51 | 0.343783224 | 0.4988 |
| hCV1463222 | rs4744808 | hCV1463244 | rs3793465 | 0.51 | 0.343783224 | 0.6837 |
| hCV1463222 | rs4744808 | hCV1463247 | rs3829064 | 0.51 | 0.343783224 | 0.5777 |
| hCV1463222 | rs4744808 | hCV1463251 | rs2498434 | 0.51 | 0.343783224 | 0.4995 |
| hCV1463222 | rs4744808 | hCV1463252 | rs3793461 | 0.51 | 0.343783224 | 0.6777 |
| hCV1463222 | rs4744808 | hCV1463256 | rs2309394 | 0.51 | 0.343783224 | 0.4563 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV1463222 | rs4744808 | hCV15761059 | rs2309393 | 0.51 | 0.343783224 | 0.6837 |
| hCV1463222 | rs4744808 | hCV15892414 | rs2498431 | 0.51 | 0.343783224 | 0.4988 |
| hCV1463222 | rs4744808 | hCV15892430 | rs2498433 | 0.51 | 0.343783224 | 0.3691 |
| hCV1463222 | rs4744808 | hCV25609765 | rs3829062 | 0.51 | 0.343783224 | 0.4563 |
| hCV1463222 | rs4744808 | hCV26566199 | rs3793467 | 0.51 | 0.343783224 | 0.6777 |
| hCV1463222 | rs4744808 | hCV26566299 | rs10869821 | 0.51 | 0.343783224 | 1 |
| hCV1463222 | rs4744808 | hCV27517372 | rs3793457 | 0.51 | 0.343783224 | 0.5504 |
| hCV1463222 | rs4744808 | hCV27996874 | rs4745701 | 0.51 | 0.343783224 | 0.3878 |
| hCV1463222 | rs4744808 | hCV28008078 | rs4745543 | 0.51 | 0.343783224 | 0.5597 |
| hCV1463222 | rs4744808 | hCV28035790 | rs4744811 | 0.51 | 0.343783224 | 0.7505 |
| hCV1463222 | rs4744808 | hCV29861776 | rs9411171 | 0.51 | 0.343783224 | 0.5777 |
| hCV1463222 | rs4744808 | hCV30586985 | rs10126006 | 0.51 | 0.343783224 | 0.6289 |
| hCV1463222 | rs4744808 | hCV31363797 | rs11145043 | 0.51 | 0.343783224 | 0.722 |
| hCV1463222 | rs4744808 | hCV31363840 | rs7875693 | 0.51 | 0.343783224 | 0.6922 |
| hCV1463222 | rs4744808 | hCV31363841 | rs7849347 | 0.51 | 0.343783224 | 0.7494 |
| hCV1463222 | rs4744808 | hCV31363869 | rs11145070 | 0.51 | 0.343783224 | 1 |
| hCV1463222 | rs4744808 | hCV31363888 | rs7859021 | 0.51 | 0.343783224 | 1 |
| hCV1463222 | rs4744808 | hCV31363984 | rs7855905 | 0.51 | 0.343783224 | 0.6837 |
| hCV1463222 | rs4744808 | hCV31364141 | rs11145460 | 0.51 | 0.343783224 | 0.3887 |
| hCV1463222 | rs4744808 | hCV320569 | rs9411170 | 0.51 | 0.343783224 | 0.444 |
| hCV1463222 | rs4744808 | hCV8785184 | rs1411676 | 0.51 | 0.343783224 | 1 |
| hCV1463222 | rs4744808 | hCV8785185 | rs1411675 | 0.51 | 0.343783224 | 1 |
| hCV1463222 | rs4744808 | hCV9333267 | rs1045632 | 0.51 | 0.343783224 | 1 |
| hCV1463222 | rs4744808 | hDV71871695 | rs7047274 | 0.51 | 0.343783224 | 0.4858 |
| hCV1488444 | rs10164405 | hCV1488443 | rs10409390 | 0.51 | 0.9 | 0.9556 |
| hCV1488444 | rs10164405 | hCV1488445 | rs2020362 | 0.51 | 0.9 | 0.9556 |
| hCV1488444 | rs10164405 | hCV1488457 | rs1529736 | 0.51 | 0.9 | 0.915 |
| hCV1488444 | rs10164405 | hCV27115656 | rs17546075 | 0.51 | 0.9 | 0.9755 |
| hCV1488444 | rs10164405 | hCV27115659 | rs10424169 | 0.51 | 0.9 | 0.9755 |
| hCV1488444 | rs10164405 | hCV27115660 | rs10423958 | 0.51 | 0.9 | 0.9556 |
| hCV1488444 | rs10164405 | hCV27115665 | rs17628547 | 0.51 | 0.9 | 0.9556 |
| hCV1488444 | rs10164405 | hCV27115673 | rs7351092 | 0.51 | 0.9 | 0.9118 |
| hCV1488444 | rs10164405 | hCV29999392 | rs10405722 | 0.51 | 0.9 | 0.9755 |
| hCV1488444 | rs10164405 | hCV30197290 | rs10405541 | 0.51 | 0.9 | 0.9755 |
| hCV1488444 | rs10164405 | hCV30467374 | rs10402416 | 0.51 | 0.9 | 0.9755 |
| hCV1488444 | rs10164405 | hCV3057588 | rs12977165 | 0.51 | 0.9 | 0.9514 |
| hCV1488444 | rs10164405 | hCV3057604 | rs17628655 | 0.51 | 0.9 | 0.9035 |
| hCV1488444 | rs10164405 | hDV70967049 | rs17545436 | 0.51 | 0.9 | 0.9135 |
| hCV1488444 | rs10164405 | hDV70967068 | rs17545624 | 0.51 | 0.9 | 0.9278 |
| hCV1488444 | rs10164405 | hDV70967114 | rs17545970 | 0.51 | 0.9 | 0.9124 |
| hCV1488444 | rs10164405 | hDV70979159 | rs17628152 | 0.51 | 0.9 | 0.9755 |
| hCV1488444 | rs10164405 | hDV70979177 | rs17628232 | 0.51 | 0.9 | 0.9755 |
| hCV1488444 | rs10164405 | hDV75173800 | rs17628099 | 0.51 | 0.9 | 0.9088 |
| hCV1489995 | rs4013819 | hCV1489958 | rs1501572 | 0.51 | 0.9 | 0.9295 |
| hCV1489995 | rs4013819 | hCV1489988 | rs7036937 | 0.51 | 0.9 | 1 |
| hCV1489995 | rs4013819 | hCV1489991 | rs10968723 | 0.51 | 0.9 | 0.9618 |
| hCV1489995 | rs4013819 | hCV1489993 | rs2134110 | 0.51 | 0.9 | 1 |
| hCV1489995 | rs4013819 | hCV1489996 | rs10120379 | 0.51 | 0.9 | 0.9611 |
| hCV1489995 | rs4013819 | hCV1490005 | rs7848307 | 0.51 | 0.9 | 0.9425 |
| hCV1489995 | rs4013819 | hCV27089552 | rs7868575 | 0.51 | 0.9 | 0.9431 |
| hCV1489995 | rs4013819 | hCV29340958 | rs7862374 | 0.51 | 0.9 | 0.9431 |
| hCV1489995 | rs4013819 | hCV31943333 | rs12339768 | 0.51 | 0.9 | 0.9648 |
| hCV1489995 | rs4013819 | hCV31943390 | rs10968708 | 0.51 | 0.9 | 0.9415 |
| hCV1552894 | rs434473 | hCV12121729 | rs10852889 | 0.51 | 0.9 | 1 |
| hCV1552894 | rs434473 | hCV1552899 | rs2292353 | 0.51 | 0.9 | 1 |
| hCV1552894 | rs434473 | hCV1552900 | rs1126667 | 0.51 | 0.9 | 1 |
| hCV1552894 | rs434473 | hCV1552901 | rs1042356 | 0.51 | 0.9 | 1 |
| hCV1552894 | rs434473 | hCV1552908 | rs312466 | 0.51 | 0.9 | 0.9811 |
| hCV1552894 | rs434473 | hCV15867474 | rs2070590 | 0.51 | 0.9 | 1 |
| hCV1552894 | rs434473 | hCV16195939 | rs2070589 | 0.51 | 0.9 | 1 |
| hCV1552894 | rs434473 | hCV31413421 | rs6502998 | 0.51 | 0.9 | 0.9435 |
| hCV1552894 | rs434473 | hCV9277205 | rs6502999 | 0.51 | 0.9 | 0.9646 |
| hCV1552900 | rs1126667 | hCV12121729 | rs10852889 | 0.51 | 0.9 | 1 |
| hCV1552900 | rs1126667 | hCV1552894 | rs434473 | 0.51 | 0.9 | 1 |
| hCV1552900 | rs1126667 | hCV1552899 | rs2292353 | 0.51 | 0.9 | 1 |
| hCV1552900 | rs1126667 | hCV1552901 | rs1042356 | 0.51 | 0.9 | 1 |
| hCV1552900 | rs1126667 | hCV1552908 | rs312466 | 0.51 | 0.9 | 0.9808 |
| hCV1552900 | rs1126667 | hCV15867474 | rs2070590 | 0.51 | 0.9 | 1 |
| hCV1552900 | rs1126667 | hCV16195939 | rs2070589 | 0.51 | 0.9 | 1 |
| hCV1552900 | rs1126667 | hCV31413421 | rs6502998 | 0.51 | 0.9 | 0.9426 |
| hCV1552900 | rs1126667 | hCV9277205 | rs6502999 | 0.51 | 0.9 | 0.9634 |
| hCV15758290 | rs6716834 | hCV1533428 | rs2544376 | 0.51 | 0.9 | 0.9765 |
| hCV15758290 | rs6716834 | hCV8822225 | rs2544377 | 0.51 | 0.9 | 1 |
| hCV15758290 | rs6716834 | hCV8822233 | rs861239 | 0.51 | 0.9 | 1 |
| hCV15758290 | rs6716834 | hCV95255 | rs2544381 | 0.51 | 0.9 | 0.9776 |
| hCV15758290 | rs6716834 | hCV95256 | rs2544380 | 0.51 | 0.9 | 1 |
| hCV15851779 | rs2230009 | hCV12105879 | rs2037962 | 0.51 | 0.9 | 1 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV15851779 | rs2230009 | hCV15793665 | rs3087418 | 0.51 | 0.9 | 1 |
| hCV15851779 | rs2230009 | hCV25471760 | rs3087409 | 0.51 | 0.9 | 1 |
| hCV15851779 | rs2230009 | hCV25921517 | rs3213197 | 0.51 | 0.9 | 1 |
| hCV15851779 | rs2230009 | hCV25921527 | rs4987239 | 0.51 | 0.9 | 1 |
| hCV15851779 | rs2230009 | hCV27829132 | rs11574175 | 0.51 | 0.9 | 1 |
| hCV15851779 | rs2230009 | hCV31337210 | rs11574400 | 0.51 | 0.9 | 0.9286 |
| hCV15851779 | rs2230009 | hCV31674015 | rs11574266 | 0.51 | 0.9 | 1 |
| hCV15851779 | rs2230009 | hCV31674023 | rs7829687 | 0.51 | 0.9 | 1 |
| hCV15851779 | rs2230009 | hCV31674032 | rs11574260 | 0.51 | 0.9 | 1 |
| hCV15851779 | rs2230009 | hCV31674034 | rs11574259 | 0.51 | 0.9 | 1 |
| hCV15851779 | rs2230009 | hCV31674062 | rs11574238 | 0.51 | 0.9 | 1 |
| hCV15851779 | rs2230009 | hCV31674064 | rs11574235 | 0.51 | 0.9 | 0.9327 |
| hCV15851779 | rs2230009 | hCV31674067 | rs11574227 | 0.51 | 0.9 | 1 |
| hCV15851779 | rs2230009 | hCV31674074 | rs11574220 | 0.51 | 0.9 | 1 |
| hCV15851779 | rs2230009 | hCV31674103 | rs7003607 | 0.51 | 0.9 | 1 |
| hCV15851779 | rs2230009 | hDV70705670 | rs16877715 | 0.51 | 0.9 | 1 |
| hCV15870728 | rs2943245 | hCV3033539 | rs2663041 | 0.51 | 0.9 | 0.9342 |
| hCV15870728 | rs2943245 | hCV3033560 | rs2671694 | 0.51 | 0.9 | 0.9319 |
| hCV15876011 | rs2228541 | hCV1260386 | rs8005533 | 0.51 | 0.9 | 1 |
| hCV15876011 | rs2228541 | hCV1260388 | rs11160169 | 0.51 | 0.9 | 1 |
| hCV15876011 | rs2228541 | hCV30012503 | rs10498639 | 0.51 | 0.9 | 0.9628 |
| hCV15876011 | rs2228541 | hCV30246438 | rs8023023 | 0.51 | 0.9 | 1 |
| hCV15876011 | rs2228541 | hCV31536164 | rs11627651 | 0.51 | 0.9 | 1 |
| hCV15876011 | rs2228541 | hCV31536166 | rs11622970 | 0.51 | 0.9 | 1 |
| hCV15892430 | rs2498433 | hCV11765753 | rs3793456 | 0.51 | 0.49786513 | 0.5315 |
| hCV15892430 | rs2498433 | hCV1463101 | rs7871596 | 0.51 | 0.49786513 | 0.6974 |
| hCV15892430 | rs2498433 | hCV1463197 | rs6560551 | 0.51 | 0.49786513 | 0.5544 |
| hCV15892430 | rs2498433 | hCV1463217 | rs4745580 | 0.51 | 0.49786513 | 0.5544 |
| hCV15892430 | rs2498433 | hCV1463223 | rs4744807 | 0.51 | 0.49786513 | 0.5544 |
| hCV15892430 | rs2498433 | hCV1463229 | rs7861997 | 0.51 | 0.49786513 | 0.5055 |
| hCV15892430 | rs2498433 | hCV1463231 | rs7870295 | 0.51 | 0.49786513 | 0.5544 |
| hCV15892430 | rs2498433 | hCV1463235 | rs2498430 | 0.51 | 0.49786513 | 0.7645 |
| hCV15892430 | rs2498433 | hCV1463247 | rs3829064 | 0.51 | 0.49786513 | 0.7486 |
| hCV15892430 | rs2498433 | hCV1463251 | rs2498434 | 0.51 | 0.49786513 | 0.7304 |
| hCV15892430 | rs2498433 | hCV1463252 | rs3793461 | 0.51 | 0.49786513 | 0.608 |
| hCV15892430 | rs2498433 | hCV1463256 | rs2309394 | 0.51 | 0.49786513 | 0.7999 |
| hCV15892430 | rs2498433 | hCV15892414 | rs2498431 | 0.51 | 0.49786513 | 0.7645 |
| hCV15892430 | rs2498433 | hCV25609765 | rs3829062 | 0.51 | 0.49786513 | 0.7999 |
| hCV15892430 | rs2498433 | hCV26566199 | rs3793467 | 0.51 | 0.49786513 | 0.608 |
| hCV15892430 | rs2498433 | hCV27517372 | rs3793457 | 0.51 | 0.49786513 | 0.7181 |
| hCV15892430 | rs2498433 | hCV28008078 | rs4745543 | 0.51 | 0.49786513 | 0.5053 |
| hCV15892430 | rs2498433 | hCV28035790 | rs4744811 | 0.51 | 0.49786513 | 0.5181 |
| hCV15892430 | rs2498433 | hCV29861776 | rs9411171 | 0.51 | 0.49786513 | 0.7486 |
| hCV15892430 | rs2498433 | hCV30586985 | rs10126006 | 0.51 | 0.49786513 | 0.5477 |
| hCV15892430 | rs2498433 | hCV31363797 | rs11145043 | 0.51 | 0.49786513 | 0.5225 |
| hCV15892430 | rs2498433 | hCV31363840 | rs7875693 | 0.51 | 0.49786513 | 0.5159 |
| hCV15892430 | rs2498433 | hCV31363841 | rs7849347 | 0.51 | 0.49786513 | 0.556 |
| hCV15892430 | rs2498433 | hCV31363984 | rs7855905 | 0.51 | 0.49786513 | 0.5225 |
| hCV15892430 | rs2498433 | hCV320569 | rs9411170 | 0.51 | 0.49786513 | 0.7647 |
| hCV15892430 | rs2498433 | hDV71871695 | rs7047274 | 0.51 | 0.49786513 | 0.7304 |
| hCV15954277 | rs2236379 | hCV1872594 | rs1886050 | 0.51 | 0.9 | 1 |
| hCV15954277 | rs2236379 | hCV27483955 | rs3793729 | 0.51 | 0.9 | 0.9075 |
| hCV15954645 | rs2954029 | hCV11593303 | rs2980871 | 0.51 | 0.9 | 0.9306 |
| hCV15954645 | rs2954029 | hCV12004940 | rs2001844 | 0.51 | 0.9 | 0.9655 |
| hCV15954645 | rs2954029 | hCV15883779 | rs2980869 | 0.51 | 0.9 | 0.9634 |
| hCV15954645 | rs2954029 | hCV15883790 | rs2980875 | 0.51 | 0.9 | 1 |
| hCV15954645 | rs2954029 | hCV15954624 | rs2954022 | 0.51 | 0.9 | 1 |
| hCV15954645 | rs2954029 | hCV26372062 | rs2980856 | 0.51 | 0.9 | 0.9634 |
| hCV15954645 | rs2954029 | hCV26372064 | rs2980855 | 0.51 | 0.9 | 0.9655 |
| hCV15954645 | rs2954029 | hCV26372065 | rs2980854 | 0.51 | 0.9 | 0.9655 |
| hCV15954645 | rs2954029 | hCV26372066 | rs2980853 | 0.51 | 0.9 | 0.9634 |
| hCV15954645 | rs2954029 | hCV26372069 | rs2980882 | 0.51 | 0.9 | 0.9655 |
| hCV15954645 | rs2954029 | hCV29719123 | rs6982636 | 0.51 | 0.9 | 0.9634 |
| hCV15954645 | rs2954029 | hCV309481 | rs2954019 | 0.51 | 0.9 | 0.9655 |
| hCV15954645 | rs2954029 | hCV469160 | rs2954031 | 0.51 | 0.9 | 0.9652 |
| hCV15954645 | rs2954029 | hCV85515 | rs10808546 | 0.51 | 0.9 | 0.9627 |
| hCV15954645 | rs2954029 | hDV70938014 | rs17321515 | 0.51 | 0.9 | 0.9634 |
| hCV15963535 | rs2228591 | hCV1685900 | rs11989173 | 0.51 | 0.9 | 1 |
| hCV15963535 | rs2228591 | hCV1685923 | rs11986247 | 0.51 | 0.9 | 1 |
| hCV15963535 | rs2228591 | hCV1685972 | rs11993681 | 0.51 | 0.9 | 1 |
| hCV15963535 | rs2228591 | hCV1685995 | rs4737303 | 0.51 | 0.9 | 1 |
| hCV15963535 | rs2228591 | hCV1685996 | rs11986140 | 0.51 | 0.9 | 1 |
| hCV15963535 | rs2228591 | hCV1747726 | rs1046013 | 0.51 | 0.9 | 1 |
| hCV15963535 | rs2228591 | hCV26137599 | rs4236981 | 0.51 | 0.9 | 1 |
| hCV15963535 | rs2228591 | hCV26137622 | rs2290878 | 0.51 | 0.9 | 1 |
| hCV15963535 | rs2228591 | hCV26137632 | rs4236983 | 0.51 | 0.9 | 1 |
| hCV15963535 | rs2228591 | hCV27988605 | rs4738086 | 0.51 | 0.9 | 1 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV15963535 | rs2228591 | hCV28010537 | rs4738085 | 0.51 | 0.9 | 1 |
| hCV15963535 | rs2228591 | hCV28966688 | rs6985242 | 0.51 | 0.9 | 1 |
| hCV15963535 | rs2228591 | hCV28966697 | rs7824655 | 0.51 | 0.9 | 1 |
| hCV15963535 | rs2228591 | hCV29002921 | rs6980582 | 0.51 | 0.9 | 1 |
| hCV15963535 | rs2228591 | hCV29769542 | rs10435576 | 0.51 | 0.9 | 1 |
| hCV15963535 | rs2228591 | hCV30095235 | rs10504468 | 0.51 | 0.9 | 1 |
| hCV15963535 | rs2228591 | hCV30711319 | rs11990849 | 0.51 | 0.9 | 1 |
| hCV15963535 | rs2228591 | hCV30711334 | rs12056650 | 0.51 | 0.9 | 1 |
| hCV15963535 | rs2228591 | hCV30820702 | rs12056770 | 0.51 | 0.9 | 1 |
| hCV15963535 | rs2228591 | hCV30820703 | rs4738072 | 0.51 | 0.9 | 1 |
| hCV15963535 | rs2228591 | hCV32300506 | rs4738084 | 0.51 | 0.9 | 1 |
| hCV15963535 | rs2228591 | hCV8340770 | rs3892265 | 0.51 | 0.9 | 1 |
| hCV15963535 | rs2228591 | hDV70748336 | rs16936768 | 0.51 | 0.9 | 1 |
| hCV15963535 | rs2228591 | hDV70748364 | rs16936806 | 0.51 | 0.9 | 1 |
| hCV15963535 | rs2228591 | hDV70748367 | rs16936812 | 0.51 | 0.9 | 1 |
| hCV15963535 | rs2228591 | hDV70748369 | rs16936814 | 0.51 | 0.9 | 1 |
| hCV15963535 | rs2228591 | hDV70748371 | rs16936816 | 0.51 | 0.9 | 1 |
| hCV15963535 | rs2228591 | hDV70748397 | rs16936858 | 0.51 | 0.9 | 1 |
| hCV15963535 | rs2228591 | hDV70748406 | rs16936875 | 0.51 | 0.9 | 1 |
| hCV15963535 | rs2228591 | hDV70748417 | rs16936890 | 0.51 | 0.9 | 1 |
| hCV15963535 | rs2228591 | hDV70748418 | rs16936891 | 0.51 | 0.9 | 1 |
| hCV15963535 | rs2228591 | hDV70748437 | rs16936913 | 0.51 | 0.9 | 1 |
| hCV15963535 | rs2228591 | hDV70748439 | rs16936916 | 0.51 | 0.9 | 1 |
| hCV15963535 | rs2228591 | hDV70748441 | rs16936918 | 0.51 | 0.9 | 1 |
| hCV15963535 | rs2228591 | hDV70748443 | rs16936921 | 0.51 | 0.9 | 1 |
| hCV15963535 | rs2228591 | hDV70748446 | rs16936925 | 0.51 | 0.9 | 1 |
| hCV15963535 | rs2228591 | hDV70748455 | rs16936937 | 0.51 | 0.9 | 1 |
| hCV15963535 | rs2228591 | hDV70748457 | rs16936940 | 0.51 | 0.9 | 1 |
| hCV15963535 | rs2228591 | hDV70748474 | rs16936971 | 0.51 | 0.9 | 1 |
| hCV15963535 | rs2228591 | hDV71598930 | rs16936746 | 0.51 | 0.9 | 1 |
| hCV15963535 | rs2228591 | hDV71598935 | rs16936923 | 0.51 | 0.9 | 1 |
| hCV15963535 | rs2228591 | hDV77039578 | rs4738081 | 0.51 | 0.9 | 1 |
| hCV15963535 | rs2228591 | hDV81067598 | rs41391448 | 0.51 | 0.9 | 1 |
| hCV16065831 | rs2765507 | hCV1188662 | rs4908519 | 0.51 | 0.77524667 | 1 |
| hCV16065831 | rs2765507 | hCV15932989 | rs2781064 | 0.51 | 0.77524667 | 1 |
| hCV16140621 | rs2156552 | hCV15846640 | rs2187375 | 0.51 | 0.9 | 1 |
| hCV16140621 | rs2156552 | hCV27889421 | rs4939883 | 0.51 | 0.9 | 0.9392 |
| hCV16140621 | rs2156552 | hCV29202191 | rs7240405 | 0.51 | 0.9 | 0.9694 |
| hCV16140621 | rs2156552 | hCV29202193 | rs7239867 | 0.51 | 0.9 | 0.9694 |
| hCV16140621 | rs2156552 | hCV29202195 | rs8086351 | 0.51 | 0.9 | 1 |
| hCV16140621 | rs2156552 | hCV30011938 | rs7241918 | 0.51 | 0.9 | 0.9366 |
| hCV16140621 | rs2156552 | hCV30606396 | rs10438978 | 0.51 | 0.9 | 0.9392 |
| hCV16140621 | rs2156552 | hDV71197604 | rs1943981 | 0.51 | 0.9 | 1 |
| hCV16173091 | rs2241883 | hCV7933022 | rs1545223 | 0.51 | 0.9 | 0.9789 |
| hCV16179628 | rs2273697 | hCV31656838 | rs11190291 | 0.51 | 0.9 | 1 |
| hCV16179628 | rs2273697 | hCV31656920 | rs11595888 | 0.51 | 0.9 | 1 |
| hCV16182835 | rs2274736 | hCV11474667 | rs10150311 | 0.51 | 0.9 | 0.9163 |
| hCV16182835 | rs2274736 | hCV11474668 | rs10138002 | 0.51 | 0.9 | 0.9163 |
| hCV16182835 | rs2274736 | hCV11474679 | rs2778936 | 0.51 | 0.9 | 0.9591 |
| hCV16182835 | rs2274736 | hCV11666712 | rs1864747 | 0.51 | 0.9 | 0.919 |
| hCV16182835 | rs2274736 | hCV11666713 | rs1864746 | 0.51 | 0.9 | 0.919 |
| hCV16182835 | rs2274736 | hCV11666724 | rs1864744 | 0.51 | 0.9 | 1 |
| hCV16182835 | rs2274736 | hCV16185886 | rs2297129 | 0.51 | 0.9 | 1 |
| hCV16182835 | rs2274736 | hCV2231821 | rs453112 | 0.51 | 0.9 | 0.9596 |
| hCV16182835 | rs2274736 | hCV2485039 | rs3179969 | 0.51 | 0.9 | 0.9793 |
| hCV16182835 | rs2274736 | hCV25935678 | rs4904452 | 0.51 | 0.9 | 0.9573 |
| hCV16182835 | rs2274736 | hCV25942539 | rs2401751 | 0.51 | 0.9 | 1 |
| hCV16182835 | rs2274736 | hCV27202496 | rs1099698 | 0.51 | 0.9 | 0.9558 |
| hCV16182835 | rs2274736 | hCV27202543 | rs7146241 | 0.51 | 0.9 | 0.9591 |
| hCV16182835 | rs2274736 | hCV29385782 | rs7141608 | 0.51 | 0.9 | 0.9591 |
| hCV16182835 | rs2274736 | hCV30414828 | rs7144432 | 0.51 | 0.9 | 0.9596 |
| hCV16182835 | rs2274736 | hCV32095396 | rs11845147 | 0.51 | 0.9 | 0.919 |
| hCV16182835 | rs2274736 | hCV32095401 | rs11847417 | 0.51 | 0.9 | 0.9163 |
| hCV16182835 | rs2274736 | hCV32095402 | rs11159857 | 0.51 | 0.9 | 0.919 |
| hCV16182835 | rs2274736 | hCV32095403 | rs4390529 | 0.51 | 0.9 | 0.917 |
| hCV16182835 | rs2274736 | hCV32095404 | rs4301952 | 0.51 | 0.9 | 0.919 |
| hCV16182835 | rs2274736 | hCV32095422 | rs2033418 | 0.51 | 0.9 | 0.9135 |
| hCV16182835 | rs2274736 | hCV32095429 | rs12436642 | 0.51 | 0.9 | 0.9381 |
| hCV16182835 | rs2274736 | hCV3211540 | rs2274735 | 0.51 | 0.9 | 0.9793 |
| hCV16182835 | rs2274736 | hCV3211544 | rs9323830 | 0.51 | 0.9 | 0.919 |
| hCV16182835 | rs2274736 | hCV3211545 | rs7160647 | 0.51 | 0.9 | 0.9163 |
| hCV16182835 | rs2274736 | hCV3211546 | rs7143642 | 0.51 | 0.9 | 0.919 |
| hCV16182835 | rs2274736 | hCV3211548 | rs7151164 | 0.51 | 0.9 | 0.919 |
| hCV16182835 | rs2274736 | hCV3211561 | rs8017811 | 0.51 | 0.9 | 0.9581 |
| hCV16182835 | rs2274736 | hCV3211562 | rs4904454 | 0.51 | 0.9 | 0.9596 |
| hCV16182835 | rs2274736 | hCV3211566 | rs930181 | 0.51 | 0.9 | 0.9591 |
| hCV16182835 | rs2274736 | hCV3211568 | rs816075 | 0.51 | 0.9 | 1 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV16182835 | rs2274736 | hCV9595827 | rs845757 | 0.51 | 0.9 | 0.9591 |
| hCV16182835 | rs2274736 | hCV9595840 | rs816072 | 0.51 | 0.9 | 1 |
| hCV16182835 | rs2274736 | hCV9595849 | rs1152376 | 0.51 | 0.9 | 0.9793 |
| hCV16182835 | rs2274736 | hCV9595856 | rs816069 | 0.51 | 0.9 | 0.9586 |
| hCV16182835 | rs2274736 | hCV9595863 | rs1344747 | 0.51 | 0.9 | 0.9596 |
| hCV16189421 | rs1048755 | hCV11473248 | rs1997920 | 0.51 | 0.9 | 1 |
| hCV16189421 | rs1048755 | hCV11473252 | rs7155310 | 0.51 | 0.9 | 1 |
| hCV16189421 | rs1048755 | hCV11473253 | rs7155635 | 0.51 | 0.9 | 1 |
| hCV16189421 | rs1048755 | hCV11473256 | rs7149775 | 0.51 | 0.9 | 1 |
| hCV16189421 | rs1048755 | hCV11473288 | rs12589059 | 0.51 | 0.9 | 1 |
| hCV16189421 | rs1048755 | hCV11473298 | rs910368 | 0.51 | 0.9 | 1 |
| hCV16189421 | rs1048755 | hCV11666124 | rs1107115 | 0.51 | 0.9 | 1 |
| hCV16189421 | rs1048755 | hCV15953441 | rs2235978 | 0.51 | 0.9 | 1 |
| hCV16189421 | rs1048755 | hCV16009742 | rs2402105 | 0.51 | 0.9 | 1 |
| hCV16189421 | rs1048755 | hCV16009749 | rs2402104 | 0.51 | 0.9 | 1 |
| hCV16189421 | rs1048755 | hCV16009750 | rs2402103 | 0.51 | 0.9 | 1 |
| hCV16189421 | rs1048755 | hCV16151209 | rs2896195 | 0.51 | 0.9 | 1 |
| hCV16189421 | rs1048755 | hCV16189366 | rs2295172 | 0.51 | 0.9 | 1 |
| hCV16189421 | rs1048755 | hCV16189376 | rs2295170 | 0.51 | 0.9 | 1 |
| hCV16189421 | rs1048755 | hCV16189431 | rs2295176 | 0.51 | 0.9 | 1 |
| hCV16189421 | rs1048755 | hCV2485342 | rs11160036 | 0.51 | 0.9 | 1 |
| hCV16189421 | rs1048755 | hCV2485343 | rs11849778 | 0.51 | 0.9 | 0.9746 |
| hCV16189421 | rs1048755 | hCV2485368 | rs8004149 | 0.51 | 0.9 | 1 |
| hCV16189421 | rs1048755 | hCV2485382 | rs10145950 | 0.51 | 0.9 | 1 |
| hCV16189421 | rs1048755 | hCV2485383 | rs11850101 | 0.51 | 0.9 | 1 |
| hCV16189421 | rs1048755 | hCV27204297 | rs12588287 | 0.51 | 0.9 | 1 |
| hCV16189421 | rs1048755 | hCV27204321 | rs4410011 | 0.51 | 0.9 | 1 |
| hCV16189421 | rs1048755 | hCV27521335 | rs3819780 | 0.51 | 0.9 | 1 |
| hCV16189421 | rs1048755 | hCV29386488 | rs8014385 | 0.51 | 0.9 | 1 |
| hCV16189421 | rs1048755 | hCV29386491 | rs4420459 | 0.51 | 0.9 | 1 |
| hCV16189421 | rs1048755 | hCV29603168 | rs10151170 | 0.51 | 0.9 | 1 |
| hCV16189421 | rs1048755 | hCV29838284 | rs10220696 | 0.51 | 0.9 | 1 |
| hCV16189421 | rs1048755 | hCV2985692 | rs8020781 | 0.51 | 0.9 | 0.9243 |
| hCV16189421 | rs1048755 | hCV2985693 | rs8019838 | 0.51 | 0.9 | 0.9547 |
| hCV16189421 | rs1048755 | hCV2985702 | rs1997919 | 0.51 | 0.9 | 0.9744 |
| hCV16189421 | rs1048755 | hCV29892477 | rs10140469 | 0.51 | 0.9 | 1 |
| hCV16189421 | rs1048755 | hCV30018528 | rs10146249 | 0.51 | 0.9 | 1 |
| hCV16189421 | rs1048755 | hCV30198588 | rs2896190 | 0.51 | 0.9 | 1 |
| hCV16189421 | rs1048755 | hCV30306469 | rs10142041 | 0.51 | 0.9 | 1 |
| hCV16189421 | rs1048755 | hCV32097347 | rs7143616 | 0.51 | 0.9 | 0.9539 |
| hCV16189421 | rs1048755 | hCV32097348 | rs7143907 | 0.51 | 0.9 | 1 |
| hCV16189421 | rs1048755 | hCV32097368 | rs7154147 | 0.51 | 0.9 | 1 |
| hCV16189421 | rs1048755 | hCV32097372 | rs7157769 | 0.51 | 0.9 | 1 |
| hCV16189421 | rs1048755 | hCV328703 | rs8003041 | 0.51 | 0.9 | 1 |
| hCV16189421 | rs1048755 | hCV344444 | rs10146087 | 0.51 | 0.9 | 1 |
| hCV16189421 | rs1048755 | hCV344813 | rs4904831 | 0.51 | 0.9 | 1 |
| hCV16189421 | rs1048755 | hCV595209 | rs761552 | 0.51 | 0.9 | 1 |
| hCV16189421 | rs1048755 | hCV595211 | rs1072958 | 0.51 | 0.9 | 1 |
| hCV16189421 | rs1048755 | hCV595212 | rs1072957 | 0.51 | 0.9 | 1 |
| hCV16189421 | rs1048755 | hCV7585140 | rs910369 | 0.51 | 0.9 | 1 |
| hCV16189421 | rs1048755 | hCV7585145 | rs709930 | 0.51 | 0.9 | 1 |
| hCV16189421 | rs1048755 | hCV7585174 | rs978220 | 0.51 | 0.9 | 1 |
| hCV16189421 | rs1048755 | hCV9832141 | rs7158300 | 0.51 | 0.9 | 0.9745 |
| hCV16189421 | rs1048755 | hDV70888558 | rs17127928 | 0.51 | 0.9 | 1 |
| hCV16189421 | rs1048755 | hDV70888566 | rs17127939 | 0.51 | 0.9 | 1 |
| hCV16189421 | rs1048755 | hDV72084520 | rs28628431 | 0.51 | 0.9 | 1 |
| hCV16189421 | rs1048755 | hDV74779425 | rs1047795 | 0.51 | 0.9 | 1 |
| hCV1647371 | rs3025000 | hCV11400859 | rs3024997 | 0.51 | 0.9 | 0.9788 |
| hCV1647371 | rs3025000 | hCV11400863 | rs833069 | 0.51 | 0.9 | 0.9788 |
| hCV1647371 | rs3025000 | hCV11400864 | rs833068 | 0.51 | 0.9 | 0.9788 |
| hCV1682755 | rs9424977 | hCV1682752 | rs1776012 | 0.51 | 0.9 | 1 |
| hCV1682755 | rs9424977 | hCV1682759 | rs1380995 | 0.51 | 0.9 | 0.9641 |
| hCV1682755 | rs9424977 | hCV1682760 | rs12137231 | 0.51 | 0.9 | 0.981 |
| hCV1682755 | rs9424977 | hCV1682766 | rs11584611 | 0.51 | 0.9 | 1 |
| hCV1682755 | rs9424977 | hCV1682769 | rs3101340 | 0.51 | 0.9 | 0.981 |
| hCV1682755 | rs9424977 | hCV1682771 | rs1870676 | 0.51 | 0.9 | 0.9245 |
| hCV1729928 | rs10509384 | hCV3096709 | rs11599090 | 0.51 | 0.9 | 1 |
| hCV1741111 | rs1764391 | hCV1741093 | rs564226 | 0.51 | 0.9 | 0.979 |
| hCV1741111 | rs1764391 | hCV1741105 | rs592345 | 0.51 | 0.9 | 1 |
| hCV1802755 | rs7764347 | hCV11314898 | rs643550 | 0.51 | 0.9 | 1 |
| hCV1802755 | rs7764347 | hCV11961611 | rs1970175 | 0.51 | 0.9 | 1 |
| hCV1802755 | rs7764347 | hCV15951664 | rs2225709 | 0.51 | 0.9 | 1 |
| hCV1802755 | rs7764347 | hCV15988356 | rs2353358 | 0.51 | 0.9 | 1 |
| hCV1802755 | rs7764347 | hCV1781490 | rs783646 | 0.51 | 0.9 | 1 |
| hCV1802755 | rs7764347 | hCV1781491 | rs783647 | 0.51 | 0.9 | 1 |
| hCV1802755 | rs7764347 | hCV1781496 | rs1413731 | 0.51 | 0.9 | 1 |
| hCV1802755 | rs7764347 | hCV1781498 | rs1741681 | 0.51 | 0.9 | 1 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV1802755 | rs7764347 | hCV1781503 | rs1761859 | 0.51 | 0.9 | 1 |
| hCV1802755 | rs7764347 | hCV1781508 | rs1334661 | 0.51 | 0.9 | 1 |
| hCV1802755 | rs7764347 | hCV1781514 | rs1334668 | 0.51 | 0.9 | 1 |
| hCV1802755 | rs7764347 | hCV1781516 | rs1761877 | 0.51 | 0.9 | 0.9476 |
| hCV1802755 | rs7764347 | hCV1781517 | rs1761878 | 0.51 | 0.9 | 0.9336 |
| hCV1802755 | rs7764347 | hCV1781518 | rs1741659 | 0.51 | 0.9 | 1 |
| hCV1802755 | rs7764347 | hCV2331531 | rs675233 | 0.51 | 0.9 | 1 |
| hCV1802755 | rs7764347 | hCV2331532 | rs675266 | 0.51 | 0.9 | 1 |
| hCV1802755 | rs7764347 | hCV2331533 | rs676152 | 0.51 | 0.9 | 1 |
| hCV1802755 | rs7764347 | hCV2331534 | rs611349 | 0.51 | 0.9 | 1 |
| hCV1802755 | rs7764347 | hCV2331538 | rs595698 | 0.51 | 0.9 | 0.9709 |
| hCV1802755 | rs7764347 | hCV2331539 | rs675811 | 0.51 | 0.9 | 1 |
| hCV1802755 | rs7764347 | hCV2331544 | rs584917 | 0.51 | 0.9 | 1 |
| hCV1802755 | rs7764347 | hCV27445091 | rs11153642 | 0.51 | 0.9 | 0.9438 |
| hCV1802755 | rs7764347 | hCV27960157 | rs4946206 | 0.51 | 0.9 | 1 |
| hCV1802755 | rs7764347 | hCV28025437 | rs4946204 | 0.51 | 0.9 | 1 |
| hCV1802755 | rs7764347 | hCV29435273 | rs7755357 | 0.51 | 0.9 | 0.9476 |
| hCV1802755 | rs7764347 | hCV29435327 | rs7774506 | 0.51 | 0.9 | 1 |
| hCV1802755 | rs7764347 | hCV29435328 | rs7770158 | 0.51 | 0.9 | 1 |
| hCV1802755 | rs7764347 | hCV29948127 | rs9489073 | 0.51 | 0.9 | 1 |
| hCV1802755 | rs7764347 | hCV30056225 | rs9489067 | 0.51 | 0.9 | 1 |
| hCV1802755 | rs7764347 | hCV3082217 | rs610979 | 0.51 | 0.9 | 1 |
| hCV1802755 | rs7764347 | hCV3082220 | rs645745 | 0.51 | 0.9 | 1 |
| hCV1802755 | rs7764347 | hCV3082221 | rs627551 | 0.51 | 0.9 | 1 |
| hCV1802755 | rs7764347 | hCV3082222 | rs643943 | 0.51 | 0.9 | 1 |
| hCV1802755 | rs7764347 | hCV3082224 | rs643474 | 0.51 | 0.9 | 1 |
| hCV1802755 | rs7764347 | hCV3082225 | rs639170 | 0.51 | 0.9 | 1 |
| hCV1802755 | rs7764347 | hCV3082226 | rs639646 | 0.51 | 0.9 | 1 |
| hCV1802755 | rs7764347 | hCV3082228 | rs616347 | 0.51 | 0.9 | 1 |
| hCV1802755 | rs7764347 | hCV3082230 | rs630434 | 0.51 | 0.9 | 1 |
| hCV1802755 | rs7764347 | hCV3082231 | rs630458 | 0.51 | 0.9 | 1 |
| hCV1802755 | rs7764347 | hCV7808534 | rs1761864 | 0.51 | 0.9 | 1 |
| hCV1802755 | rs7764347 | hCV858258 | rs768582 | 0.51 | 0.9 | 1 |
| hCV1802755 | rs7764347 | hCV858259 | rs768581 | 0.51 | 0.9 | 1 |
| hCV1802755 | rs7764347 | hCV872305 | rs657963 | 0.51 | 0.9 | 1 |
| hCV1802755 | rs7764347 | hCV872306 | rs625821 | 0.51 | 0.9 | 1 |
| hCV1802755 | rs7764347 | hCV872307 | rs631089 | 0.51 | 0.9 | 1 |
| hCV1802755 | rs7764347 | hCV872308 | rs630695 | 0.51 | 0.9 | 1 |
| hCV1802755 | rs7764347 | hCV872309 | rs617426 | 0.51 | 0.9 | 1 |
| hCV1802755 | rs7764347 | hCV872311 | rs632159 | 0.51 | 0.9 | 1 |
| hCV1802755 | rs7764347 | hCV8769445 | rs706939 | 0.51 | 0.9 | 1 |
| hCV1802755 | rs7764347 | hCV8769455 | rs783650 | 0.51 | 0.9 | 1 |
| hCV1802755 | rs7764347 | hCV8769456 | rs783651 | 0.51 | 0.9 | 1 |
| hCV1802755 | rs7764347 | hCV8769472 | rs945134 | 0.51 | 0.9 | 0.971 |
| hCV1802755 | rs7764347 | hCV8769473 | rs1761832 | 0.51 | 0.9 | 1 |
| hCV1802755 | rs7764347 | hCV8769480 | rs1741672 | 0.51 | 0.9 | 1 |
| hCV1802755 | rs7764347 | hCV8769486 | rs1761834 | 0.51 | 0.9 | 1 |
| hCV1802755 | rs7764347 | hCV8769500 | rs1334653 | 0.51 | 0.9 | 1 |
| hCV1802755 | rs7764347 | hCV8769524 | rs1761841 | 0.51 | 0.9 | 1 |
| hCV1802755 | rs7764347 | hCV8769525 | rs1741682 | 0.51 | 0.9 | 1 |
| hCV1802755 | rs7764347 | hCV8769536 | rs1761844 | 0.51 | 0.9 | 1 |
| hCV1802755 | rs7764347 | hCV8769537 | rs1761845 | 0.51 | 0.9 | 1 |
| hCV1802755 | rs7764347 | hCV8769547 | rs1741687 | 0.51 | 0.9 | 1 |
| hCV1802755 | rs7764347 | hCV8769554 | rs1761847 | 0.51 | 0.9 | 1 |
| hCV1802755 | rs7764347 | hCV8769556 | rs16849 | 0.51 | 0.9 | 1 |
| hCV1802755 | rs7764347 | hCV8769586 | rs1334657 | 0.51 | 0.9 | 1 |
| hCV1802755 | rs7764347 | hCV8769595 | rs1334659 | 0.51 | 0.9 | 1 |
| hCV1802755 | rs7764347 | hCV8769596 | rs1334660 | 0.51 | 0.9 | 1 |
| hCV1802755 | rs7764347 | hCV8769605 | rs1406981 | 0.51 | 0.9 | 0.9476 |
| hCV1802755 | rs7764347 | hCV8769606 | rs1406983 | 0.51 | 0.9 | 1 |
| hCV1802755 | rs7764347 | hCV8769616 | rs1413740 | 0.51 | 0.9 | 1 |
| hCV1802755 | rs7764347 | hCV8769617 | rs1413741 | 0.51 | 0.9 | 1 |
| hCV1802755 | rs7764347 | hCV8769624 | rs1413742 | 0.51 | 0.9 | 1 |
| hCV1802755 | rs7764347 | hCV8769625 | rs1334662 | 0.51 | 0.9 | 1 |
| hCV1802755 | rs7764347 | hCV8769626 | rs1334663 | 0.51 | 0.9 | 1 |
| hCV1802755 | rs7764347 | hCV8769647 | rs1761860 | 0.51 | 0.9 | 1 |
| hCV1802755 | rs7764347 | hCV8769648 | rs1761861 | 0.51 | 0.9 | 1 |
| hCV1802755 | rs7764347 | hCV8769649 | rs1761862 | 0.51 | 0.9 | 0.971 |
| hCV1802755 | rs7764347 | hCV8769656 | rs1741651 | 0.51 | 0.9 | 1 |
| hCV1802755 | rs7764347 | hCV8769657 | rs1761865 | 0.51 | 0.9 | 1 |
| hCV1802755 | rs7764347 | hCV8769665 | rs1334666 | 0.51 | 0.9 | 1 |
| hCV1802755 | rs7764347 | hCV8769677 | rs1334667 | 0.51 | 0.9 | 1 |
| hCV1802755 | rs7764347 | hCV8769688 | rs1334669 | 0.51 | 0.9 | 1 |
| hCV1802755 | rs7764347 | hCV8769690 | rs1761874 | 0.51 | 0.9 | 1 |
| hCV1802755 | rs7764347 | hCV8769713 | rs1741660 | 0.51 | 0.9 | 1 |
| hCV1802755 | rs7764347 | hCV8769714 | rs1741661 | 0.51 | 0.9 | 1 |
| hCV1802755 | rs7764347 | hCV8769723 | rs1741662 | 0.51 | 0.9 | 1 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV1802755 | rs7764347 | hCV8769734 | rs677383 | 0.51 | 0.9 | 1 |
| hCV1802755 | rs7764347 | hDV75232846 | rs2353359 | 0.51 | 0.9 | 1 |
| hCV1948599 | rs504527 | hCV952816 | rs495444 | 0.51 | 0.9 | 0.9634 |
| hCV2038 | rs4673 | hCV11291915 | rs4782308 | 0.51 | 0.9 | 0.9561 |
| hCV2038 | rs4673 | hCV25647671 | rs12933505 | 0.51 | 0.9 | 0.9783 |
| hCV207123 | rs7771801 | hCV103951 | rs6455688 | 0.51 | 0.442309245 | 1 |
| hCV207123 | rs7771801 | hCV103951 | rs6455688 | 0.51 | 0.608405136 | 1 |
| hCV207123 | rs7771801 | hCV103952 | rs6923877 | 0.51 | 0.442309245 | 1 |
| hCV207123 | rs7771801 | hCV103952 | rs6923877 | 0.51 | 0.608405136 | 1 |
| hCV207123 | rs7771801 | hCV11226249 | rs6415085 | 0.51 | 0.442309245 | 0.7706 |
| hCV207123 | rs7771801 | hCV11226249 | rs6415085 | 0.51 | 0.608405136 | 0.7706 |
| hCV207123 | rs7771801 | hCV11284288 | rs9457946 | 0.51 | 0.442309245 | 1 |
| hCV207123 | rs7771801 | hCV11284288 | rs9457946 | 0.51 | 0.608405136 | 1 |
| hCV207123 | rs7771801 | hCV11846435 | rs6929299 | 0.51 | 0.442309245 | 0.7556 |
| hCV207123 | rs7771801 | hCV11846435 | rs6929299 | 0.51 | 0.608405136 | 0.7556 |
| hCV207123 | rs7771801 | hCV1550866 | rs6932014 | 0.51 | 0.442309245 | 0.7706 |
| hCV207123 | rs7771801 | hCV1550866 | rs6932014 | 0.51 | 0.608405136 | 0.7706 |
| hCV207123 | rs7771801 | hCV1550871 | rs9355295 | 0.51 | 0.442309245 | 1 |
| hCV207123 | rs7771801 | hCV1550871 | rs9355295 | 0.51 | 0.608405136 | 1 |
| hCV207123 | rs7771801 | hCV207127 | rs7453899 | 0.51 | 0.442309245 | 1 |
| hCV207123 | rs7771801 | hCV207127 | rs7453899 | 0.51 | 0.608405136 | 1 |
| hCV207123 | rs7771801 | hCV207128 | rs6455689 | 0.51 | 0.442309245 | 1 |
| hCV207123 | rs7771801 | hCV207128 | rs6455689 | 0.51 | 0.608405136 | 1 |
| hCV207123 | rs7771801 | hCV243055 | rs10945682 | 0.51 | 0.442309245 | 0.7556 |
| hCV207123 | rs7771801 | hCV243055 | rs10945682 | 0.51 | 0.608405136 | 0.7556 |
| hCV207123 | rs7771801 | hCV249895 | rs7771129 | 0.51 | 0.442309245 | 0.7706 |
| hCV207123 | rs7771801 | hCV249895 | rs7771129 | 0.51 | 0.608405136 | 0.7706 |
| hCV207123 | rs7771801 | hCV249897 | rs6913833 | 0.51 | 0.442309245 | 0.6956 |
| hCV207123 | rs7771801 | hCV249897 | rs6913833 | 0.51 | 0.608405136 | 0.6956 |
| hCV207123 | rs7771801 | hCV249898 | rs9456552 | 0.51 | 0.442309245 | 0.7815 |
| hCV207123 | rs7771801 | hCV249898 | rs9456552 | 0.51 | 0.608405136 | 0.7815 |
| hCV207123 | rs7771801 | hCV25929408 | rs7765781 | 0.51 | 0.442309245 | 1 |
| hCV207123 | rs7771801 | hCV25929408 | rs7765781 | 0.51 | 0.608405136 | 1 |
| hCV207123 | rs7771801 | hCV25929478 | rs7765803 | 0.51 | 0.442309245 | 1 |
| hCV207123 | rs7771801 | hCV25929478 | rs7765803 | 0.51 | 0.608405136 | 1 |
| hCV207123 | rs7771801 | hCV26272389 | rs7760585 | 0.51 | 0.442309245 | 0.7556 |
| hCV207123 | rs7771801 | hCV26272389 | rs7760585 | 0.51 | 0.608405136 | 0.7556 |
| hCV207123 | rs7771801 | hCV27422546 | rs7761377 | 0.51 | 0.442309245 | 0.7343 |
| hCV207123 | rs7771801 | hCV27422546 | rs7761377 | 0.51 | 0.608405136 | 0.7343 |
| hCV207123 | rs7771801 | hCV27422547 | rs6455696 | 0.51 | 0.442309245 | 0.739 |
| hCV207123 | rs7771801 | hCV27422547 | rs6455696 | 0.51 | 0.608405136 | 0.739 |
| hCV207123 | rs7771801 | hCV27422554 | rs6923917 | 0.51 | 0.442309245 | 0.7556 |
| hCV207123 | rs7771801 | hCV27422554 | rs6923917 | 0.51 | 0.608405136 | 0.7556 |
| hCV207123 | rs7771801 | hCV27422556 | rs9355814 | 0.51 | 0.442309245 | 0.7541 |
| hCV207123 | rs7771801 | hCV27422556 | rs9355814 | 0.51 | 0.608405136 | 0.7541 |
| hCV207123 | rs7771801 | hCV27422557 | rs9355813 | 0.51 | 0.442309245 | 0.7052 |
| hCV207123 | rs7771801 | hCV27422557 | rs9355813 | 0.51 | 0.608405136 | 0.7052 |
| hCV207123 | rs7771801 | hCV29322781 | rs6921516 | 0.51 | 0.442309245 | 1 |
| hCV207123 | rs7771801 | hCV29322781 | rs6921516 | 0.51 | 0.608405136 | 1 |
| hCV207123 | rs7771801 | hCV29546641 | rs9365171 | 0.51 | 0.442309245 | 0.8426 |
| hCV207123 | rs7771801 | hCV29546641 | rs9365171 | 0.51 | 0.608405136 | 0.8426 |
| hCV207123 | rs7771801 | hCV29709361 | rs9365179 | 0.51 | 0.442309245 | 0.7271 |
| hCV207123 | rs7771801 | hCV29709361 | rs9365179 | 0.51 | 0.608405136 | 0.7271 |
| hCV207123 | rs7771801 | hCV29817515 | rs9355817 | 0.51 | 0.442309245 | 0.703 |
| hCV207123 | rs7771801 | hCV29817515 | rs9355817 | 0.51 | 0.608405136 | 0.703 |
| hCV207123 | rs7771801 | hCV29934611 | rs9295130 | 0.51 | 0.442309245 | 0.7512 |
| hCV207123 | rs7771801 | hCV29934611 | rs9295130 | 0.51 | 0.608405136 | 0.7512 |
| hCV207123 | rs7771801 | hCV29998162 | rs9457943 | 0.51 | 0.442309245 | 1 |
| hCV207123 | rs7771801 | hCV29998162 | rs9457943 | 0.51 | 0.608405136 | 1 |
| hCV207123 | rs7771801 | hCV305046 | rs6902102 | 0.51 | 0.442309245 | 0.764 |
| hCV207123 | rs7771801 | hCV305046 | rs6902102 | 0.51 | 0.608405136 | 0.764 |
| hCV207123 | rs7771801 | hCV3201494 | rs1367209 | 0.51 | 0.442309245 | 0.8378 |
| hCV207123 | rs7771801 | hCV3201494 | rs1367209 | 0.51 | 0.608405136 | 0.8378 |
| hCV207123 | rs7771801 | hCV3201497 | rs1321196 | 0.51 | 0.442309245 | 0.7556 |
| hCV207123 | rs7771801 | hCV3201497 | rs1321196 | 0.51 | 0.608405136 | 0.7556 |
| hCV207123 | rs7771801 | hCV8710154 | rs1569933 | 0.51 | 0.442309245 | 0.7512 |
| hCV207123 | rs7771801 | hCV8710154 | rs1569933 | 0.51 | 0.608405136 | 0.7512 |
| hCV207123 | rs7771801 | hCV8710161 | rs1740428 | 0.51 | 0.442309245 | 0.7556 |
| hCV207123 | rs7771801 | hCV8710161 | rs1740428 | 0.51 | 0.608405136 | 0.7556 |
| hCV207123 | rs7771801 | hCV8710162 | rs1367211 | 0.51 | 0.442309245 | 0.8378 |
| hCV207123 | rs7771801 | hCV8710162 | rs1367211 | 0.51 | 0.608405136 | 0.8378 |
| hCV207123 | rs7771801 | hDV77235995 | rs7746273 | 0.51 | 0.442309245 | 0.7058 |
| hCV207123 | rs7771801 | hDV77235995 | rs7746273 | 0.51 | 0.608405136 | 0.7058 |
| hCV2143205 | rs9666607 | hCV1622732 | rs10768114 | 0.51 | 0.9 | 0.9787 |
| hCV2195496 | rs4982795 | hCV2195484 | rs7156111 | 0.51 | 0.9 | 0.9811 |
| hCV22274679 | rs3812475 | hCV11595113 | rs12548235 | 0.51 | 0.776093561 | 0.9434 |
| hCV22274679 | rs3812475 | hCV11595482 | rs7830506 | 0.51 | 0.776093561 | 0.9811 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV22274679 | rs3812475 | hCV149577 | rs10091243 | 0.51 | 0.776093561 | 0.9281 |
| hCV22274679 | rs3812475 | hCV149578 | rs10106292 | 0.51 | 0.776093561 | 0.9294 |
| hCV22274679 | rs3812475 | hCV157937 | rs7013683 | 0.51 | 0.776093561 | 1 |
| hCV22274679 | rs3812475 | hCV1843454 | rs3812472 | 0.51 | 0.776093561 | 1 |
| hCV22274679 | rs3812475 | hCV26088153 | rs4871498 | 0.51 | 0.776093561 | 1 |
| hCV22274679 | rs3812475 | hCV27535572 | rs4128468 | 0.51 | 0.776093561 | 1 |
| hCV22274679 | rs3812475 | hCV29086592 | rs7812911 | 0.51 | 0.776093561 | 1 |
| hCV22274679 | rs3812475 | hCV30756534 | rs3886003 | 0.51 | 0.776093561 | 1 |
| hCV22274679 | rs3812475 | hCV314558 | rs7007115 | 0.51 | 0.776093561 | 0.8874 |
| hCV22274679 | rs3812475 | hCV314561 | rs7009290 | 0.51 | 0.776093561 | 0.9294 |
| hCV22274679 | rs3812475 | hCV314562 | rs6982197 | 0.51 | 0.776093561 | 0.9434 |
| hCV22274679 | rs3812475 | hCV314563 | rs4269526 | 0.51 | 0.776093561 | 0.9434 |
| hCV22274679 | rs3812475 | hCV314564 | rs4269525 | 0.51 | 0.776093561 | 0.9434 |
| hCV22274679 | rs3812475 | hCV430717 | rs3812471 | 0.51 | 0.776093561 | 1 |
| hCV22274679 | rs3812475 | hCV437982 | rs4132855 | 0.51 | 0.776093561 | 0.7934 |
| hCV22274679 | rs3812475 | hCV47808 | rs7827791 | 0.51 | 0.776093561 | 0.9294 |
| hCV22274679 | rs3812475 | hCV480457 | rs6987343 | 0.51 | 0.776093561 | 0.9248 |
| hCV22275550 | rs6836335 | hCV1161362 | rs11732057 | 0.51 | 0.9 | 1 |
| hCV22275550 | rs6836335 | hCV1161370 | rs10002248 | 0.51 | 0.9 | 1 |
| hCV22275550 | rs6836335 | hCV22273485 | rs17164384 | 0.51 | 0.9 | 1 |
| hCV22275550 | rs6836335 | hCV29285080 | rs7690832 | 0.51 | 0.9 | 1 |
| hCV22275550 | rs6836335 | hCV29285086 | rs6599285 | 0.51 | 0.9 | 1 |
| hCV22275550 | rs6836335 | hCV29285088 | rs6599284 | 0.51 | 0.9 | 1 |
| hCV22275550 | rs6836335 | hCV29285089 | rs7679718 | 0.51 | 0.9 | 1 |
| hCV22275550 | rs6836335 | hCV29617776 | rs10014245 | 0.51 | 0.9 | 1 |
| hCV22275550 | rs6836335 | hCV29762412 | rs7676956 | 0.51 | 0.9 | 1 |
| hCV22275550 | rs6836335 | hCV30104919 | rs10002437 | 0.51 | 0.9 | 1 |
| hCV22275550 | rs6836335 | hCV30302937 | rs6836158 | 0.51 | 0.9 | 1 |
| hCV22275550 | rs6836335 | hDV71950388 | rs7684536 | 0.51 | 0.9 | 0.9076 |
| hCV22275550 | rs6836335 | hDV71951681 | rs7690300 | 0.51 | 0.9 | 1 |
| hCV22303 | rs4552916 | hCV22304 | rs4350001 | 0.51 | 0.9 | 1 |
| hCV22303 | rs4552916 | hCV31093200 | rs12164213 | 0.51 | 0.9 | 1 |
| hCV22303 | rs4552916 | hCV54111 | rs16900644 | 0.51 | 0.9 | 1 |
| hCV2310409 | rs675 | hCV2679567 | rs5095 | 0.51 | 0.9 | 0.9459 |
| hCV2310409 | rs675 | hCV8907584 | rs1263167 | 0.51 | 0.9 | 1 |
| hCV25472345 | rs4900072 | hCV25472340 | rs4900071 | 0.51 | 0.9 | 1 |
| hCV25472345 | rs4900072 | hCV28023407 | rs4904753 | 0.51 | 0.9 | 1 |
| hCV25472345 | rs4900072 | hCV29585238 | rs10148571 | 0.51 | 0.9 | 0.9615 |
| hCV25472673 | rs1805081 | hCV12087063 | rs1367085 | 0.51 | 0.9 | 0.9646 |
| hCV25472673 | rs1805081 | hCV3203987 | rs12966114 | 0.51 | 0.9 | 0.9646 |
| hCV2554615 | rs2522057 | hCV15849790 | rs2188962 | 0.51 | 0.9 | 0.9608 |
| hCV2554615 | rs2522057 | hCV15891730 | rs2522052 | 0.51 | 0.9 | 1 |
| hCV2554615 | rs2522057 | hCV2554569 | rs11951091 | 0.51 | 0.9 | 0.9297 |
| hCV2554615 | rs2522057 | hCV2554574 | rs6866614 | 0.51 | 0.9 | 1 |
| hCV2554615 | rs2522057 | hCV2554620 | rs2248116 | 0.51 | 0.9 | 1 |
| hCV2554615 | rs2522057 | hCV2843371 | rs736801 | 0.51 | 0.9 | 0.9271 |
| hCV2554615 | rs2522057 | hCV31237908 | rs12515180 | 0.51 | 0.9 | 0.9257 |
| hCV2554615 | rs2522057 | hCV31237910 | rs12521868 | 0.51 | 0.9 | 0.9606 |
| hCV2554615 | rs2522057 | hCV3170459 | rs1050152 | 0.51 | 0.9 | 0.9037 |
| hCV2554615 | rs2522057 | hCV3281563 | rs11741255 | 0.51 | 0.9 | 0.9605 |
| hCV2554615 | rs2522057 | hDV70978119 | rs17622378 | 0.51 | 0.9 | 0.9287 |
| hCV2554615 | rs2522057 | hDV77036076 | rs4705950 | 0.51 | 0.9 | 1 |
| hCV2554721 | rs7315519 | hCV2261914 | rs739744 | 0.51 | 0.9 | 1 |
| hCV2554721 | rs7315519 | hCV2554699 | rs4767000 | 0.51 | 0.9 | 0.9596 |
| hCV2554721 | rs7315519 | hCV2554701 | rs4767002 | 0.51 | 0.9 | 0.9596 |
| hCV2554721 | rs7315519 | hCV2554707 | rs7314022 | 0.51 | 0.9 | 0.9388 |
| hCV2554721 | rs7315519 | hCV2554718 | rs4767003 | 0.51 | 0.9 | 1 |
| hCV2554721 | rs7315519 | hCV2554725 | rs2189271 | 0.51 | 0.9 | 1 |
| hCV2554721 | rs7315519 | hCV31831562 | rs7313341 | 0.51 | 0.9 | 0.9596 |
| hCV2557331 | rs233716 | hCV2557336 | rs233722 | 0.51 | 0.9 | 1 |
| hCV25596880 | rs4647297 | hCV30006064 | rs10255320 | 0.51 | 0.9 | 1 |
| hCV25596880 | rs4647297 | hCV943516 | rs3886700 | 0.51 | 0.9 | 1 |
| hCV25596880 | rs4647297 | hDV70910833 | rs17164171 | 0.51 | 0.9 | 1 |
| hCV25596880 | rs4647297 | hDV77029169 | rs4647342 | 0.51 | 0.9 | 1 |
| hCV25605897 | rs11568563 | hCV31107079 | rs7966334 | 0.51 | 0.9 | 1 |
| hCV25610774 | rs8176748 | hCV12020218 | rs613423 | 0.51 | 0.9 | 1 |
| hCV25610774 | rs8176748 | hCV12020219 | rs624601 | 0.51 | 0.9 | 1 |
| hCV25610774 | rs8176748 | hCV16163350 | rs2073825 | 0.51 | 0.9 | 1 |
| hCV25610774 | rs8176748 | hCV25610819 | rs8176740 | 0.51 | 0.9 | 1 |
| hCV25610774 | rs8176748 | hCV25610830 | rs8176717 | 0.51 | 0.9 | 1 |
| hCV25610774 | rs8176748 | hCV25610847 | rs8176714 | 0.51 | 0.9 | 1 |
| hCV25610774 | rs8176748 | hCV26744836 | rs500428 | 0.51 | 0.9 | 1 |
| hCV25610774 | rs8176748 | hCV26744838 | rs502361 | 0.51 | 0.9 | 1 |
| hCV25610774 | rs8176748 | hCV29669589 | rs8176732 | 0.51 | 0.9 | 1 |
| hCV25610774 | rs8176748 | hCV30120679 | rs8176728 | 0.51 | 0.9 | 1 |
| hCV25610774 | rs8176748 | hCV30192755 | rs568203 | 0.51 | 0.9 | 1 |
| hCV25610774 | rs8176748 | hCV30534973 | rs626035 | 0.51 | 0.9 | 1 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV25610774 | rs8176748 | hCV30661132 | rs11244053 | 0.51 | 0.9 | 1 |
| hCV25610774 | rs8176748 | hCV3183108 | rs474279 | 0.51 | 0.9 | 1 |
| hCV25610774 | rs8176748 | hCV3183120 | rs574311 | 0.51 | 0.9 | 1 |
| hCV25610774 | rs8176748 | hCV8784787 | rs688976 | 0.51 | 0.9 | 1 |
| hCV25610774 | rs8176748 | hCV8784788 | rs493211 | 0.51 | 0.9 | 0.9467 |
| hCV25610774 | rs8176748 | hCV997885 | rs641959 | 0.51 | 0.9 | 0.9081 |
| hCV25610774 | rs8176748 | hCV997886 | rs641943 | 0.51 | 0.9 | 0.902 |
| hCV25610774 | rs8176748 | hCV997887 | rs514708 | 0.51 | 0.9 | 0.902 |
| hCV25610774 | rs8176748 | hCV997888 | rs517414 | 0.51 | 0.9 | 1 |
| hCV25610774 | rs8176748 | hCV997889 | rs638756 | 0.51 | 0.9 | 0.9472 |
| hCV25610774 | rs8176748 | hCV997893 | rs547643 | 0.51 | 0.9 | 1 |
| hCV25610774 | rs8176748 | hCV997897 | rs549446 | 0.51 | 0.9 | 1 |
| hCV25610774 | rs8176748 | hCV997902 | rs574347 | 0.51 | 0.9 | 1 |
| hCV25610774 | rs8176748 | hCV997904 | rs579483 | 0.51 | 0.9 | 1 |
| hCV25610774 | rs8176748 | hCV997905 | rs579622 | 0.51 | 0.9 | 1 |
| hCV25610774 | rs8176748 | hCV997906 | rs672316 | 0.51 | 0.9 | 0.902 |
| hCV25610774 | rs8176748 | hCV997925 | rs552148 | 0.51 | 0.9 | 1 |
| hCV25610774 | rs8176748 | hDV77084283 | rs549331 | 0.51 | 0.9 | 1 |
| hCV25610774 | rs8176748 | hDV81175228 | rs625593 | 0.51 | 0.9 | 1 |
| hCV25610819 | rs8176740 | hCV12020218 | rs613423 | 0.51 | 0.9 | 1 |
| hCV25610819 | rs8176740 | hCV12020219 | rs624601 | 0.51 | 0.9 | 1 |
| hCV25610819 | rs8176740 | hCV16163350 | rs2073825 | 0.51 | 0.9 | 1 |
| hCV25610819 | rs8176740 | hCV25610774 | rs8176748 | 0.51 | 0.9 | 1 |
| hCV25610819 | rs8176740 | hCV25610830 | rs8176717 | 0.51 | 0.9 | 1 |
| hCV25610819 | rs8176740 | hCV25610847 | rs8176714 | 0.51 | 0.9 | 1 |
| hCV25610819 | rs8176740 | hCV26744836 | rs500428 | 0.51 | 0.9 | 1 |
| hCV25610819 | rs8176740 | hCV26744838 | rs502361 | 0.51 | 0.9 | 1 |
| hCV25610819 | rs8176740 | hCV29669589 | rs8176732 | 0.51 | 0.9 | 1 |
| hCV25610819 | rs8176740 | hCV30120679 | rs8176728 | 0.51 | 0.9 | 1 |
| hCV25610819 | rs8176740 | hCV30192755 | rs568203 | 0.51 | 0.9 | 1 |
| hCV25610819 | rs8176740 | hCV30534973 | rs626035 | 0.51 | 0.9 | 1 |
| hCV25610819 | rs8176740 | hCV30661132 | rs11244053 | 0.51 | 0.9 | 1 |
| hCV25610819 | rs8176740 | hCV3183108 | rs474279 | 0.51 | 0.9 | 1 |
| hCV25610819 | rs8176740 | hCV3183120 | rs574311 | 0.51 | 0.9 | 1 |
| hCV25610819 | rs8176740 | hCV8784787 | rs688976 | 0.51 | 0.9 | 1 |
| hCV25610819 | rs8176740 | hCV8784788 | rs493211 | 0.51 | 0.9 | 0.9515 |
| hCV25610819 | rs8176740 | hCV997885 | rs641959 | 0.51 | 0.9 | 0.9157 |
| hCV25610819 | rs8176740 | hCV997886 | rs641943 | 0.51 | 0.9 | 0.91 |
| hCV25610819 | rs8176740 | hCV997887 | rs514708 | 0.51 | 0.9 | 0.91 |
| hCV25610819 | rs8176740 | hCV997888 | rs517414 | 0.51 | 0.9 | 1 |
| hCV25610819 | rs8176740 | hCV997889 | rs638756 | 0.51 | 0.9 | 0.9521 |
| hCV25610819 | rs8176740 | hCV997893 | rs547643 | 0.51 | 0.9 | 1 |
| hCV25610819 | rs8176740 | hCV997897 | rs549446 | 0.51 | 0.9 | 1 |
| hCV25610819 | rs8176740 | hCV997902 | rs574347 | 0.51 | 0.9 | 1 |
| hCV25610819 | rs8176740 | hCV997904 | rs579483 | 0.51 | 0.9 | 1 |
| hCV25610819 | rs8176740 | hCV997905 | rs579622 | 0.51 | 0.9 | 1 |
| hCV25610819 | rs8176740 | hCV997906 | rs672316 | 0.51 | 0.9 | 0.91 |
| hCV25610819 | rs8176740 | hCV997925 | rs552148 | 0.51 | 0.9 | 1 |
| hCV25610819 | rs8176740 | hDV77084283 | rs549331 | 0.51 | 0.9 | 1 |
| hCV25610819 | rs8176740 | hDV81175228 | rs625593 | 0.51 | 0.9 | 1 |
| hCV25617571 | rs2232580 | hCV1210675 | rs11086565 | 0.51 | 0.9 | 1 |
| hCV25629476 | rs2427284 | hCV16232619 | rs2427285 | 0.51 | 0.9 | 1 |
| hCV25631989 | rs1135983 | hCV1498763 | rs2271013 | 0.51 | 0.9 | 1 |
| hCV25631989 | rs1135983 | hCV1498764 | rs2271012 | 0.51 | 0.9 | 1 |
| hCV25631989 | rs1135983 | hCV1498765 | rs1910480 | 0.51 | 0.9 | 1 |
| hCV25631989 | rs1135983 | hCV1498769 | rs10917946 | 0.51 | 0.9 | 1 |
| hCV25631989 | rs1135983 | hCV1498789 | rs12405111 | 0.51 | 0.9 | 1 |
| hCV25631989 | rs1135983 | hCV1498802 | rs7535349 | 0.51 | 0.9 | 1 |
| hCV25631989 | rs1135983 | hCV1498806 | rs7530997 | 0.51 | 0.9 | 1 |
| hCV25631989 | rs1135983 | hCV1498820 | rs955852 | 0.51 | 0.9 | 1 |
| hCV25631989 | rs1135983 | hCV15860707 | rs2070151 | 0.51 | 0.9 | 1 |
| hCV25631989 | rs1135983 | hCV15860708 | rs2070150 | 0.51 | 0.9 | 1 |
| hCV25631989 | rs1135983 | hCV15991581 | rs2340823 | 0.51 | 0.9 | 1 |
| hCV25631989 | rs1135983 | hCV16078774 | rs2879841 | 0.51 | 0.9 | 1 |
| hCV25631989 | rs1135983 | hCV16206436 | rs2341477 | 0.51 | 0.9 | 1 |
| hCV25631989 | rs1135983 | hCV27471434 | rs3738326 | 0.51 | 0.9 | 1 |
| hCV25631989 | rs1135983 | hCV27521453 | rs3820489 | 0.51 | 0.9 | 1 |
| hCV25631989 | rs1135983 | hCV27865203 | rs4657116 | 0.51 | 0.9 | 1 |
| hCV25631989 | rs1135983 | hCV27951691 | rs4657104 | 0.51 | 0.9 | 1 |
| hCV25631989 | rs1135983 | hCV28016731 | rs4657118 | 0.51 | 0.9 | 1 |
| hCV25631989 | rs1135983 | hCV29773346 | rs7523416 | 0.51 | 0.9 | 1 |
| hCV25631989 | rs1135983 | hCV29953697 | rs6687850 | 0.51 | 0.9 | 1 |
| hCV25631989 | rs1135983 | hCV30097926 | rs7545293 | 0.51 | 0.9 | 1 |
| hCV25631989 | rs1135983 | hCV30349845 | rs10494358 | 0.51 | 0.9 | 1 |
| hCV25631989 | rs1135983 | hCV30475776 | rs7532457 | 0.51 | 0.9 | 1 |
| hCV25631989 | rs1135983 | hCV31086840 | rs10799979 | 0.51 | 0.9 | 1 |
| hCV25631989 | rs1135983 | hCV31086842 | rs12040648 | 0.51 | 0.9 | 1 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV25631989 | rs1135983 | hCV31086843 | rs6427630 | 0.51 | 0.9 | 1 |
| hCV25631989 | rs1135983 | hCV31086854 | rs10917955 | 0.51 | 0.9 | 1 |
| hCV25631989 | rs1135983 | hCV31086864 | rs4656334 | 0.51 | 0.9 | 1 |
| hCV25631989 | rs1135983 | hCV31086917 | rs12025560 | 0.51 | 0.9 | 1 |
| hCV25631989 | rs1135983 | hCV31086921 | rs12028953 | 0.51 | 0.9 | 1 |
| hCV25631989 | rs1135983 | hCV31086939 | rs12040523 | 0.51 | 0.9 | 1 |
| hCV25631989 | rs1135983 | hCV31087435 | rs12026445 | 0.51 | 0.9 | 1 |
| hCV25631989 | rs1135983 | hCV32324133 | rs4657120 | 0.51 | 0.9 | 1 |
| hCV25631989 | rs1135983 | hCV49962 | rs12402354 | 0.51 | 0.9 | 1 |
| hCV25631989 | rs1135983 | hCV515827 | rs6427634 | 0.51 | 0.9 | 1 |
| hCV25631989 | rs1135983 | hCV9620270 | rs1394068 | 0.51 | 0.9 | 1 |
| hCV25631989 | rs1135983 | hCV9620271 | rs1394069 | 0.51 | 0.9 | 1 |
| hCV25631989 | rs1135983 | hCV9620977 | rs1553443 | 0.51 | 0.9 | 1 |
| hCV25631989 | rs1135983 | hDV70661530 | rs16863838 | 0.51 | 0.9 | 1 |
| hCV25631989 | rs1135983 | hDV70683947 | rs16847590 | 0.51 | 0.9 | 1 |
| hCV25767417 | rs3803430 | hCV25473269 | rs4646690 | 0.51 | 0.9 | 1 |
| hCV25767417 | rs3803430 | hCV27296381 | rs4246326 | 0.51 | 0.9 | 1 |
| hCV25767417 | rs3803430 | hCV27891437 | rs4246323 | 0.51 | 0.9 | 1 |
| hCV25767417 | rs3803430 | hCV29415509 | rs4646672 | 0.51 | 0.9 | 1 |
| hCV25767417 | rs3803430 | hCV31591253 | rs7168644 | 0.51 | 0.9 | 1 |
| hCV25767417 | rs3803430 | hDV77028856 | rs4646680 | 0.51 | 0.9 | 1 |
| hCV25767417 | rs3803430 | hDV77028857 | rs4646681 | 0.51 | 0.9 | 1 |
| hCV25767417 | rs3803430 | hDV77028859 | rs4646683 | 0.51 | 0.9 | 1 |
| hCV25922816 | rs36013429 | hCV25769066 | rs3813619 | 0.51 | 0.9 | 0.9031 |
| hCV25926771 | rs4906321 | hCV11660548 | rs1989565 | 0.51 | 0.9 | 0.9616 |
| hCV25926771 | rs4906321 | hCV1292630 | rs10133035 | 0.51 | 0.9 | 0.9039 |
| hCV25926771 | rs4906321 | hCV1292646 | rs3783402 | 0.51 | 0.9 | 0.9107 |
| hCV25926771 | rs4906321 | hCV1292649 | rs9671911 | 0.51 | 0.9 | 0.9227 |
| hCV25926771 | rs4906321 | hCV1292713 | rs10141120 | 0.51 | 0.9 | 0.92 |
| hCV25926771 | rs4906321 | hCV1292762 | rs7152202 | 0.51 | 0.9 | 0.9227 |
| hCV25926771 | rs4906321 | hCV16179592 | rs2273699 | 0.51 | 0.9 | 0.96 |
| hCV25926771 | rs4906321 | hCV26352257 | rs11621037 | 0.51 | 0.9 | 0.9227 |
| hCV25926771 | rs4906321 | hCV29078396 | rs7158822 | 0.51 | 0.9 | 0.9199 |
| hCV25926771 | rs4906321 | hCV31068323 | rs12898029 | 0.51 | 0.9 | 0.9616 |
| hCV25926771 | rs4906321 | hCV31068332 | rs7158144 | 0.51 | 0.9 | 0.9057 |
| hCV25926771 | rs4906321 | hCV8901411 | rs1028613 | 0.51 | 0.9 | 0.9226 |
| hCV25927459 | rs3798221 | hCV103951 | rs6455688 | 0.51 | 0.47241724 | 0.4725 |
| hCV25927459 | rs3798221 | hCV103952 | rs6923877 | 0.51 | 0.47241724 | 0.4725 |
| hCV25927459 | rs3798221 | hCV11285578 | rs6926458 | 0.51 | 0.47241724 | 0.7323 |
| hCV25927459 | rs3798221 | hCV26272388 | rs7770685 | 0.51 | 0.47241724 | 0.7365 |
| hCV25927459 | rs3798221 | hCV27422538 | rs6940254 | 0.51 | 0.47241724 | 0.6129 |
| hCV25927459 | rs3798221 | hCV27422565 | rs13202636 | 0.51 | 0.47241724 | 0.7365 |
| hCV25927459 | rs3798221 | hCV31882494 | rs12175867 | 0.51 | 0.47241724 | 0.6129 |
| hCV25927459 | rs3798221 | hCV3201490 | rs1321195 | 0.51 | 0.47241724 | 0.6526 |
| hCV25927459 | rs3798221 | hCV3201495 | rs1367210 | 0.51 | 0.47241724 | 0.5491 |
| hCV25927459 | rs3798221 | hCV8701273 | rs783148 | 0.51 | 0.47241724 | 0.6526 |
| hCV25941408 | rs28497577 | hCV11720681 | rs1947511 | 0.51 | 0.9 | 1 |
| hCV25941408 | rs28497577 | hCV11720683 | rs17125 | 0.51 | 0.9 | 1 |
| hCV25941408 | rs28497577 | hCV27912783 | rs4678060 | 0.51 | 0.9 | 0.9239 |
| hCV25942539 | rs2401751 | hCV11474667 | rs10150311 | 0.51 | 0.9 | 0.9163 |
| hCV25942539 | rs2401751 | hCV11474668 | rs10138002 | 0.51 | 0.9 | 0.9163 |
| hCV25942539 | rs2401751 | hCV11474679 | rs2778936 | 0.51 | 0.9 | 0.9591 |
| hCV25942539 | rs2401751 | hCV11666712 | rs1864747 | 0.51 | 0.9 | 0.919 |
| hCV25942539 | rs2401751 | hCV11666713 | rs1864746 | 0.51 | 0.9 | 0.919 |
| hCV25942539 | rs2401751 | hCV11666724 | rs1864744 | 0.51 | 0.9 | 1 |
| hCV25942539 | rs2401751 | hCV16182835 | rs2274736 | 0.51 | 0.9 | 1 |
| hCV25942539 | rs2401751 | hCV16185886 | rs2297129 | 0.51 | 0.9 | 1 |
| hCV25942539 | rs2401751 | hCV2231821 | rs453112 | 0.51 | 0.9 | 0.9596 |
| hCV25942539 | rs2401751 | hCV2485039 | rs3179969 | 0.51 | 0.9 | 0.9793 |
| hCV25942539 | rs2401751 | hCV25935678 | rs4904452 | 0.51 | 0.9 | 0.9573 |
| hCV25942539 | rs2401751 | hCV27202496 | rs1099698 | 0.51 | 0.9 | 0.9558 |
| hCV25942539 | rs2401751 | hCV27202543 | rs7146241 | 0.51 | 0.9 | 0.9591 |
| hCV25942539 | rs2401751 | hCV29385782 | rs7141608 | 0.51 | 0.9 | 0.9591 |
| hCV25942539 | rs2401751 | hCV30414828 | rs7144432 | 0.51 | 0.9 | 0.9596 |
| hCV25942539 | rs2401751 | hCV32095396 | rs11845147 | 0.51 | 0.9 | 0.919 |
| hCV25942539 | rs2401751 | hCV32095401 | rs11847417 | 0.51 | 0.9 | 0.9163 |
| hCV25942539 | rs2401751 | hCV32095402 | rs11159857 | 0.51 | 0.9 | 0.919 |
| hCV25942539 | rs2401751 | hCV32095403 | rs4390529 | 0.51 | 0.9 | 0.917 |
| hCV25942539 | rs2401751 | hCV32095404 | rs4301952 | 0.51 | 0.9 | 0.919 |
| hCV25942539 | rs2401751 | hCV32095422 | rs2033418 | 0.51 | 0.9 | 0.9135 |
| hCV25942539 | rs2401751 | hCV32095429 | rs12436642 | 0.51 | 0.9 | 0.9381 |
| hCV25942539 | rs2401751 | hCV3211540 | rs2274735 | 0.51 | 0.9 | 0.9793 |
| hCV25942539 | rs2401751 | hCV3211544 | rs9323830 | 0.51 | 0.9 | 0.919 |
| hCV25942539 | rs2401751 | hCV3211545 | rs7160647 | 0.51 | 0.9 | 0.9163 |
| hCV25942539 | rs2401751 | hCV3211546 | rs7143642 | 0.51 | 0.9 | 0.919 |
| hCV25942539 | rs2401751 | hCV3211548 | rs7151164 | 0.51 | 0.9 | 0.919 |
| hCV25942539 | rs2401751 | hCV3211561 | rs8017811 | 0.51 | 0.9 | 0.9581 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV25942539 | rs2401751 | hCV3211562 | rs4904454 | 0.51 | 0.9 | 0.9596 |
| hCV25942539 | rs2401751 | hCV3211566 | rs930181 | 0.51 | 0.9 | 0.9591 |
| hCV25942539 | rs2401751 | hCV3211568 | rs816075 | 0.51 | 0.9 | 1 |
| hCV25942539 | rs2401751 | hCV9595827 | rs845757 | 0.51 | 0.9 | 0.9591 |
| hCV25942539 | rs2401751 | hCV9595840 | rs816072 | 0.51 | 0.9 | 1 |
| hCV25942539 | rs2401751 | hCV9595849 | rs1152376 | 0.51 | 0.9 | 0.9793 |
| hCV25942539 | rs2401751 | hCV9595856 | rs816069 | 0.51 | 0.9 | 0.9586 |
| hCV25942539 | rs2401751 | hCV9595863 | rs1344747 | 0.51 | 0.9 | 0.9596 |
| hCV26000635 | rs7020782 | hCV31783431 | rs6478232 | 0.51 | 0.9 | 0.959 |
| hCV26000635 | rs7020782 | hCV7594415 | rs912214 | 0.51 | 0.9 | 0.9782 |
| hCV260164 | rs6754295 | hCV1026586 | rs673548 | 0.51 | 0.9 | 0.9441 |
| hCV260164 | rs6754295 | hCV11168524 | rs6544366 | 0.51 | 0.9 | 1 |
| hCV260164 | rs6754295 | hCV11168530 | rs6728178 | 0.51 | 0.9 | 1 |
| hCV260164 | rs6754295 | hCV27912761 | rs4564803 | 0.51 | 0.9 | 1 |
| hCV260164 | rs6754295 | hCV29011391 | rs7557067 | 0.51 | 0.9 | 1 |
| hCV260164 | rs6754295 | hCV30455594 | rs10184054 | 0.51 | 0.9 | 1 |
| hCV260164 | rs6754295 | hCV30847428 | rs11902417 | 0.51 | 0.9 | 1 |
| hCV260164 | rs6754295 | hCV3216558 | rs676210 | 0.51 | 0.9 | 0.9442 |
| hCV260164 | rs6754295 | hCV7615376 | rs1042034 | 0.51 | 0.9 | 0.9169 |
| hCV2632070 | rs714052 | hCV11449126 | rs13244268 | 0.51 | 0.9 | 1 |
| hCV2632070 | rs714052 | hCV16164914 | rs2074755 | 0.51 | 0.9 | 1 |
| hCV2632070 | rs714052 | hCV2632057 | rs12056034 | 0.51 | 0.9 | 1 |
| hCV2632070 | rs714052 | hCV2632071 | rs13231516 | 0.51 | 0.9 | 1 |
| hCV2632070 | rs714052 | hCV2632076 | rs2240466 | 0.51 | 0.9 | 1 |
| hCV2632070 | rs714052 | hCV2632532 | rs13246490 | 0.51 | 0.9 | 1 |
| hCV2632070 | rs714052 | hCV2632543 | rs13232120 | 0.51 | 0.9 | 1 |
| hCV2632070 | rs714052 | hCV2632544 | rs17145738 | 0.51 | 0.9 | 1 |
| hCV2632070 | rs714052 | hCV2632552 | rs13233571 | 0.51 | 0.9 | 1 |
| hCV2632544 | rs17145738 | hCV11449126 | rs13244268 | 0.51 | 0.9 | 1 |
| hCV2632544 | rs17145738 | hCV16164914 | rs2074755 | 0.51 | 0.9 | 1 |
| hCV2632544 | rs17145738 | hCV2632057 | rs12056034 | 0.51 | 0.9 | 1 |
| hCV2632544 | rs17145738 | hCV2632070 | rs714052 | 0.51 | 0.9 | 1 |
| hCV2632544 | rs17145738 | hCV2632071 | rs13231516 | 0.51 | 0.9 | 1 |
| hCV2632544 | rs17145738 | hCV2632076 | rs2240466 | 0.51 | 0.9 | 1 |
| hCV2632544 | rs17145738 | hCV2632532 | rs13246490 | 0.51 | 0.9 | 1 |
| hCV2632544 | rs17145738 | hCV2632543 | rs13232120 | 0.51 | 0.9 | 1 |
| hCV2632544 | rs17145738 | hCV2632552 | rs13233571 | 0.51 | 0.9 | 1 |
| hCV2658421 | rs3176975 | hCV2658407 | rs8178835 | 0.51 | 0.9 | 1 |
| hCV26660340 | rs4968246 | hCV11623006 | rs1662596 | 0.51 | 0.681759041 | 0.743 |
| hCV26660340 | rs4968246 | hCV11623026 | rs9911967 | 0.51 | 0.681759041 | 0.7492 |
| hCV26660340 | rs4968246 | hCV2275263 | rs197912 | 0.51 | 0.681759041 | 0.71 |
| hCV26660340 | rs4968246 | hCV2275276 | rs197925 | 0.51 | 0.681759041 | 0.7895 |
| hCV26660340 | rs4968246 | hCV2592646 | rs12453279 | 0.51 | 0.681759041 | 0.917 |
| hCV26660340 | rs4968246 | hCV2592661 | rs1867237 | 0.51 | 0.681759041 | 0.7492 |
| hCV26660340 | rs4968246 | hCV2592662 | rs2191033 | 0.51 | 0.681759041 | 0.7264 |
| hCV26660340 | rs4968246 | hCV26660339 | rs4968247 | 0.51 | 0.681759041 | 0.8732 |
| hCV26660340 | rs4968246 | hCV29195238 | rs7225428 | 0.51 | 0.681759041 | 0.7492 |
| hCV26660340 | rs4968246 | hCV2959472 | rs8078468 | 0.51 | 0.681759041 | 0.8732 |
| hCV26660340 | rs4968246 | hCV2960496 | rs3760374 | 0.51 | 0.681759041 | 0.8791 |
| hCV26660340 | rs4968246 | hCV7451245 | rs1662576 | 0.51 | 0.681759041 | 0.7492 |
| hCV26660340 | rs4968246 | hCV7451269 | rs1662594 | 0.51 | 0.681759041 | 0.7492 |
| hCV26660340 | rs4968246 | hCV7451288 | rs197911 | 0.51 | 0.681759041 | 0.756 |
| hCV26660340 | rs4968246 | hCV7451289 | rs1056116 | 0.51 | 0.681759041 | 0.8732 |
| hCV26660340 | rs4968246 | hCV7451308 | rs1638446 | 0.51 | 0.681759041 | 0.756 |
| hCV26683367 | rs9894300 | hCV11627552 | rs2316667 | 0.51 | 0.60059725 | 0.9066 |
| hCV26683367 | rs9894300 | hCV1718966 | rs4968305 | 0.51 | 0.60059725 | 0.9072 |
| hCV26683367 | rs9894300 | hCV26683368 | rs2004580 | 0.51 | 0.60059725 | 0.8193 |
| hCV26683367 | rs9894300 | hCV29195269 | rs7221042 | 0.51 | 0.60059725 | 0.6383 |
| hCV26683367 | rs9894300 | hCV30515746 | rs10491149 | 0.51 | 0.60059725 | 0.6383 |
| hCV26683367 | rs9894300 | hCV31479380 | rs4520895 | 0.51 | 0.60059725 | 0.8206 |
| hCV26683367 | rs9894300 | hDV70590478 | rs9897338 | 0.51 | 0.60059725 | 0.8206 |
| hCV26683367 | rs9894300 | hDV70751669 | rs16941353 | 0.51 | 0.60059725 | 0.6383 |
| hCV26683367 | rs9894300 | hDV70977122 | rs17616652 | 0.51 | 0.60059725 | 0.6395 |
| hCV26683367 | rs9894300 | hDV70987720 | rs17676978 | 0.51 | 0.60059725 | 0.6383 |
| hCV26683367 | rs9894300 | hDV75285090 | rs2667804 | 0.51 | 0.60059725 | 0.9072 |
| hCV26683368 | rs2004580 | hCV11627552 | rs2316667 | 0.51 | 0.600149065 | 0.8315 |
| hCV26683368 | rs2004580 | hCV1718966 | rs4968305 | 0.51 | 0.600149065 | 0.9076 |
| hCV26683368 | rs2004580 | hCV26683367 | rs9894300 | 0.51 | 0.600149065 | 0.8193 |
| hCV26683368 | rs2004580 | hCV31479380 | rs4520895 | 0.51 | 0.600149065 | 0.8212 |
| hCV26683368 | rs2004580 | hDV70590478 | rs9897338 | 0.51 | 0.600149065 | 0.8212 |
| hCV26683368 | rs2004580 | hDV70977122 | rs17616652 | 0.51 | 0.600149065 | 0.6405 |
| hCV26683368 | rs2004580 | hDV75285090 | rs2667804 | 0.51 | 0.600149065 | 0.9076 |
| hCV2741051 | rs2230806 | hCV15808302 | rs2253182 | 0.51 | 0.9 | 1 |
| hCV2741051 | rs2230806 | hCV15808303 | rs2253175 | 0.51 | 0.9 | 1 |
| hCV2741051 | rs2230806 | hCV15808304 | rs2253172 | 0.51 | 0.9 | 1 |
| hCV2741051 | rs2230806 | hCV16235439 | rs2472384 | 0.51 | 0.9 | 1 |
| hCV2741051 | rs2230806 | hCV16235449 | rs2253174 | 0.51 | 0.9 | 1 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV2741051 | rs2230806 | hCV16235556 | rs2253304 | 0.51 | 0.9 | 1 |
| hCV2741051 | rs2230806 | hCV16235566 | rs2472439 | 0.51 | 0.9 | 0.9413 |
| hCV2741051 | rs2230806 | hCV2960435 | rs2472433 | 0.51 | 0.9 | 0.9705 |
| hCV2741083 | rs4149313 | hCV2741071 | rs7031748 | 0.51 | 0.9 | 0.9603 |
| hCV2741083 | rs4149313 | hCV2741079 | rs4149310 | 0.51 | 0.9 | 1 |
| hCV2741083 | rs4149313 | hCV2741080 | rs3780543 | 0.51 | 0.9 | 0.9603 |
| hCV2741083 | rs4149313 | hCV27979351 | rs4149311 | 0.51 | 0.9 | 0.9603 |
| hCV2741083 | rs4149313 | hCV9306688 | rs4743762 | 0.51 | 0.9 | 0.9603 |
| hCV27422538 | rs6940254 | hCV11226249 | rs6415085 | 0.51 | 0.459494331 | 0.5362 |
| hCV27422538 | rs6940254 | hCV11285578 | rs6926458 | 0.51 | 0.459494331 | 1 |
| hCV27422538 | rs6940254 | hCV11846435 | rs6929299 | 0.51 | 0.459494331 | 0.5349 |
| hCV27422538 | rs6940254 | hCV1550866 | rs6932014 | 0.51 | 0.459494331 | 0.5362 |
| hCV27422538 | rs6940254 | hCV243055 | rs10945682 | 0.51 | 0.459494331 | 0.5349 |
| hCV27422538 | rs6940254 | hCV249895 | rs7771129 | 0.51 | 0.459494331 | 0.5362 |
| hCV27422538 | rs6940254 | hCV249898 | rs9456552 | 0.51 | 0.459494331 | 0.55 |
| hCV27422538 | rs6940254 | hCV25927459 | rs3798221 | 0.51 | 0.459494331 | 0.6129 |
| hCV27422538 | rs6940254 | hCV26272388 | rs7770685 | 0.51 | 0.459494331 | 1 |
| hCV27422538 | rs6940254 | hCV26272389 | rs7760585 | 0.51 | 0.459494331 | 0.5349 |
| hCV27422538 | rs6940254 | hCV27422546 | rs7761377 | 0.51 | 0.459494331 | 0.5504 |
| hCV27422538 | rs6940254 | hCV27422547 | rs6455696 | 0.51 | 0.459494331 | 0.5336 |
| hCV27422538 | rs6940254 | hCV27422554 | rs6923917 | 0.51 | 0.459494331 | 0.5349 |
| hCV27422538 | rs6940254 | hCV27422556 | rs9355814 | 0.51 | 0.459494331 | 0.5659 |
| hCV27422538 | rs6940254 | hCV27422557 | rs9355813 | 0.51 | 0.459494331 | 0.5875 |
| hCV27422538 | rs6940254 | hCV27422565 | rs13202636 | 0.51 | 0.459494331 | 1 |
| hCV27422538 | rs6940254 | hCV29709361 | rs9365179 | 0.51 | 0.459494331 | 0.5152 |
| hCV27422538 | rs6940254 | hCV29817515 | rs9355817 | 0.51 | 0.459494331 | 0.51 |
| hCV27422538 | rs6940254 | hCV29934611 | rs9295130 | 0.51 | 0.459494331 | 0.5291 |
| hCV27422538 | rs6940254 | hCV305046 | rs6902102 | 0.51 | 0.459494331 | 0.5232 |
| hCV27422538 | rs6940254 | hCV31882494 | rs12175867 | 0.51 | 0.459494331 | 1 |
| hCV27422538 | rs6940254 | hCV3201490 | rs1321195 | 0.51 | 0.459494331 | 0.6 |
| hCV27422538 | rs6940254 | hCV3201495 | rs1367210 | 0.51 | 0.459494331 | 0.6129 |
| hCV27422538 | rs6940254 | hCV3201497 | rs1321196 | 0.51 | 0.459494331 | 0.5349 |
| hCV27422538 | rs6940254 | hCV8701273 | rs783148 | 0.51 | 0.459494331 | 0.6 |
| hCV27422538 | rs6940254 | hCV8710154 | rs1569933 | 0.51 | 0.459494331 | 0.5291 |
| hCV27422538 | rs6940254 | hCV8710161 | rs1740428 | 0.51 | 0.459494331 | 0.5349 |
| hCV27422538 | rs6940254 | hDV77235995 | rs7746273 | 0.51 | 0.459494331 | 0.5362 |
| hCV27462774 | rs3127583 | hCV16149755 | rs2183470 | 0.51 | 0.708469605 | 1 |
| hCV27462774 | rs3127583 | hCV16149755 | rs2183470 | 0.51 | 0.756245335 | 1 |
| hCV27462774 | rs3127583 | hCV27397381 | rs3120149 | 0.51 | 0.708469605 | 1 |
| hCV27462774 | rs3127583 | hCV27397381 | rs3120149 | 0.51 | 0.756245335 | 1 |
| hCV27462774 | rs3127583 | hCV27455194 | rs3103347 | 0.51 | 0.708469605 | 0.9667 |
| hCV27462774 | rs3127583 | hCV27455194 | rs3103347 | 0.51 | 0.756245335 | 0.9667 |
| hCV27462774 | rs3127583 | hCV27459536 | rs3119310 | 0.51 | 0.708469605 | 0.776 |
| hCV27462774 | rs3127583 | hCV27459536 | rs3119310 | 0.51 | 0.756245335 | 0.776 |
| hCV27462774 | rs3127583 | hCV27460663 | rs3120137 | 0.51 | 0.708469605 | 0.9011 |
| hCV27462774 | rs3127583 | hCV27460663 | rs3120137 | 0.51 | 0.756245335 | 0.9011 |
| hCV27462774 | rs3127583 | hCV27461119 | rs3125056 | 0.51 | 0.708469605 | 0.8336 |
| hCV27462774 | rs3127583 | hCV27461119 | rs3125056 | 0.51 | 0.756245335 | 0.8336 |
| hCV27462774 | rs3127583 | hCV27462007 | rs3127578 | 0.51 | 0.708469605 | 0.776 |
| hCV27462774 | rs3127583 | hCV27462007 | rs3127578 | 0.51 | 0.756245335 | 0.776 |
| hCV27462774 | rs3127583 | hCV27462671 | rs3120139 | 0.51 | 0.708469605 | 1 |
| hCV27462774 | rs3127583 | hCV27462671 | rs3120139 | 0.51 | 0.756245335 | 1 |
| hCV27462774 | rs3127583 | hCV27464241 | rs3125052 | 0.51 | 0.708469605 | 1 |
| hCV27462774 | rs3127583 | hCV27464241 | rs3125052 | 0.51 | 0.756245335 | 1 |
| hCV27462774 | rs3127583 | hCV27464790 | rs3127591 | 0.51 | 0.708469605 | 0.9135 |
| hCV27462774 | rs3127583 | hCV27464790 | rs3127591 | 0.51 | 0.756245335 | 0.9135 |
| hCV27462774 | rs3127583 | hCV30977815 | rs3127597 | 0.51 | 0.708469605 | 0.8905 |
| hCV27462774 | rs3127583 | hCV30977815 | rs3127597 | 0.51 | 0.756245335 | 0.8905 |
| hCV27462774 | rs3127583 | hCV30977817 | rs3106168 | 0.51 | 0.708469605 | 1 |
| hCV27462774 | rs3127583 | hCV30977817 | rs3106168 | 0.51 | 0.756245335 | 1 |
| hCV27462774 | rs3127583 | hCV30977839 | rs3120140 | 0.51 | 0.708469605 | 0.8656 |
| hCV27462774 | rs3127583 | hCV30977839 | rs3120140 | 0.51 | 0.756245335 | 0.8656 |
| hCV27462774 | rs3127583 | hCV30977855 | rs3103350 | 0.51 | 0.708469605 | 1 |
| hCV27462774 | rs3127583 | hCV30977855 | rs3103350 | 0.51 | 0.756245335 | 1 |
| hCV27462774 | rs3127583 | hCV31605072 | rs12206585 | 0.51 | 0.708469605 | 1 |
| hCV27462774 | rs3127583 | hCV31605072 | rs12206585 | 0.51 | 0.756245335 | 1 |
| hCV27462774 | rs3127583 | hCV31605081 | rs12203303 | 0.51 | 0.708469605 | 0.8994 |
| hCV27462774 | rs3127583 | hCV31605081 | rs12203303 | 0.51 | 0.756245335 | 0.8994 |
| hCV27462774 | rs3127583 | hCV32312668 | rs3103349 | 0.51 | 0.708469605 | 1 |
| hCV27462774 | rs3127583 | hCV32312668 | rs3103349 | 0.51 | 0.756245335 | 1 |
| hCV27462774 | rs3127583 | hDV71669191 | rs3127586 | 0.51 | 0.708469605 | 1 |
| hCV27462774 | rs3127583 | hDV71669191 | rs3127586 | 0.51 | 0.756245335 | 1 |
| hCV27462774 | rs3127583 | hDV75428625 | rs3106167 | 0.51 | 0.708469605 | 1 |
| hCV27462774 | rs3127583 | hDV75428625 | rs3106167 | 0.51 | 0.756245335 | 1 |
| hCV27462774 | rs3127583 | hDV75428626 | rs3106170 | 0.51 | 0.708469605 | 1 |
| hCV27462774 | rs3127583 | hDV75428626 | rs3106170 | 0.51 | 0.756245335 | 1 |
| hCV27462774 | rs3127583 | hDV75428628 | rs3106172 | 0.51 | 0.708469605 | 1 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV27462774 | rs3127583 | hDV75428628 | rs3106172 | 0.51 | 0.756245335 | 1 |
| hCV27462774 | rs3127583 | hDV75431938 | rs3120151 | 0.51 | 0.708469605 | 1 |
| hCV27462774 | rs3127583 | hDV75431938 | rs3120151 | 0.51 | 0.756245335 | 1 |
| hCV27462774 | rs3127583 | hDV75433616 | rs3125049 | 0.51 | 0.708469605 | 0.9278 |
| hCV27462774 | rs3127583 | hDV75433616 | rs3125049 | 0.51 | 0.756245335 | 0.9278 |
| hCV27462774 | rs3127583 | hDV75433617 | rs3125050 | 0.51 | 0.708469605 | 1 |
| hCV27462774 | rs3127583 | hDV75433617 | rs3125050 | 0.51 | 0.756245335 | 1 |
| hCV27462774 | rs3127583 | hDV75433619 | rs3125055 | 0.51 | 0.708469605 | 0.7337 |
| hCV27480853 | rs3766430 | hCV2431627 | rs646534 | 0.51 | 0.9 | 0.9437 |
| hCV27480853 | rs3766430 | hCV27498227 | rs3766431 | 0.51 | 0.9 | 0.9805 |
| hCV27480853 | rs3766430 | hCV27498228 | rs3766436 | 0.51 | 0.9 | 0.9643 |
| hCV27480853 | rs3766430 | hCV27924561 | rs4927080 | 0.51 | 0.9 | 0.9264 |
| hCV27480853 | rs3766430 | hCV29234422 | rs3766437 | 0.51 | 0.9 | 0.9643 |
| hCV2762168 | rs3939286 | hCV12096527 | rs1888909 | 0.51 | 0.9 | 0.9767 |
| hCV2762168 | rs3939286 | hCV12096531 | rs928413 | 0.51 | 0.9 | 0.9767 |
| hCV2762168 | rs3939286 | hCV16108911 | rs2095044 | 0.51 | 0.9 | 0.9616 |
| hCV2762168 | rs3939286 | hCV16225421 | rs2381416 | 0.51 | 0.9 | 0.9252 |
| hCV2762168 | rs3939286 | hCV31940459 | rs7848215 | 0.51 | 0.9 | 0.9252 |
| hCV2762168 | rs3939286 | hCV8785827 | rs992969 | 0.51 | 0.9 | 1 |
| hCV2769554 | rs1805010 | hCV2769561 | rs3024548 | 0.51 | 0.9 | 1 |
| hCV2769554 | rs1805010 | hCV2769568 | rs3024530 | 0.51 | 0.9 | 0.926 |
| hCV2781953 | rs6021931 | hCV11182690 | rs13045199 | 0.51 | 0.9 | 0.9391 |
| hCV2781953 | rs6021931 | hCV2487050 | rs17806278 | 0.51 | 0.9 | 0.9391 |
| hCV2781953 | rs6021931 | hCV2487054 | rs13043303 | 0.51 | 0.9 | 1 |
| hCV2781953 | rs6021931 | hCV2487070 | rs6091546 | 0.51 | 0.9 | 1 |
| hCV2781953 | rs6021931 | hCV2487071 | rs1473705 | 0.51 | 0.9 | 1 |
| hCV2781953 | rs6021931 | hCV2487073 | rs17806379 | 0.51 | 0.9 | 0.9393 |
| hCV2781953 | rs6021931 | hCV2487087 | rs13037630 | 0.51 | 0.9 | 1 |
| hCV2781953 | rs6021931 | hCV2516638 | rs13037010 | 0.51 | 0.9 | 0.942 |
| hCV2781953 | rs6021931 | hCV2781950 | rs6096949 | 0.51 | 0.9 | 1 |
| hCV2781953 | rs6021931 | hCV2781958 | rs6096956 | 0.51 | 0.9 | 0.9694 |
| hCV2781953 | rs6021931 | hCV2781970 | rs17806224 | 0.51 | 0.9 | 1 |
| hCV2781953 | rs6021931 | hCV31734434 | rs13039375 | 0.51 | 0.9 | 1 |
| hCV2781953 | rs6021931 | hCV31734442 | rs13039956 | 0.51 | 0.9 | 1 |
| hCV2781953 | rs6021931 | hDV71605793 | rs17203653 | 0.51 | 0.9 | 1 |
| hCV27884601 | rs4908776 | hCV1188731 | rs4908514 | 0.51 | 0.900202572 | 1 |
| hCV27884601 | rs4908776 | hCV1188735 | rs10864366 | 0.51 | 0.900202572 | 1 |
| hCV27884601 | rs4908776 | hCV27157507 | rs6664000 | 0.51 | 0.900202572 | 1 |
| hCV27884601 | rs4908776 | hCV27157524 | rs6577531 | 0.51 | 0.900202572 | 0.9351 |
| hCV27884601 | rs4908776 | hCV28023091 | rs4908773 | 0.51 | 0.900202572 | 1 |
| hCV27884601 | rs4908776 | hCV29368919 | rs4908513 | 0.51 | 0.900202572 | 1 |
| hCV27884601 | rs4908776 | hCV29873524 | rs7533113 | 0.51 | 0.900202572 | 1 |
| hCV27884601 | rs4908776 | hCV29945430 | rs7517436 | 0.51 | 0.900202572 | 1 |
| hCV27884601 | rs4908776 | hCV30035535 | rs7518204 | 0.51 | 0.900202572 | 1 |
| hCV27884601 | rs4908776 | hCV32055527 | rs10864364 | 0.51 | 0.900202572 | 1 |
| hCV27884601 | rs4908776 | hCV32055579 | rs6577522 | 0.51 | 0.900202572 | 1 |
| hCV27884601 | rs4908776 | hCV32055595 | rs6577524 | 0.51 | 0.900202572 | 1 |
| hCV27884601 | rs4908776 | hCV32055596 | rs6577525 | 0.51 | 0.900202572 | 1 |
| hCV27884601 | rs4908776 | hCV32055637 | rs6577532 | 0.51 | 0.900202572 | 0.9312 |
| hCV27884601 | rs4908776 | hCV8823713 | rs1472228 | 0.51 | 0.900202572 | 1 |
| hCV27958354 | rs4908762 | hCV29873526 | rs6697997 | 0.51 | 0.969446018 | 1 |
| hCV27958354 | rs4908762 | hCV3086998 | rs7530863 | 0.51 | 0.969446018 | 1 |
| hCV27958354 | rs4908762 | hCV3087000 | rs1463055 | 0.51 | 0.969446018 | 1 |
| hCV27958354 | rs4908762 | hCV3087003 | rs6577500 | 0.51 | 0.969446018 | 1 |
| hCV27958354 | rs4908762 | hCV3087015 | rs11121198 | 0.51 | 0.969446018 | 1 |
| hCV27958354 | rs4908762 | hCV32055548 | rs11121197 | 0.51 | 0.969446018 | 1 |
| hCV27958354 | rs4908762 | hCV32055677 | rs10864355 | 0.51 | 0.969446018 | 1 |
| hCV27958354 | rs4908762 | hCV529178 | rs301811 | 0.51 | 0.969446018 | 1 |
| hCV27958354 | rs4908762 | hCV597227 | rs301809 | 0.51 | 0.969446018 | 1 |
| hCV27958354 | rs4908762 | hCV597229 | rs301785 | 0.51 | 0.969446018 | 1 |
| hCV27958354 | rs4908762 | hCV8824288 | rs910582 | 0.51 | 0.969446018 | 1 |
| hCV27958354 | rs4908762 | hCV8881161 | rs926951 | 0.51 | 0.969446018 | 1 |
| hCV28008078 | rs4745543 | hCV11765753 | rs3793456 | 0.51 | 0.766415386 | 0.8388 |
| hCV28008078 | rs4745543 | hCV1463112 | rs3763608 | 0.51 | 0.766415386 | 1 |
| hCV28008078 | rs4745543 | hCV1463244 | rs3793465 | 0.51 | 0.766415386 | 0.827 |
| hCV28008078 | rs4745543 | hCV1463252 | rs3793461 | 0.51 | 0.766415386 | 0.8689 |
| hCV28008078 | rs4745543 | hCV15761059 | rs2309393 | 0.51 | 0.766415386 | 0.827 |
| hCV28008078 | rs4745543 | hCV26566199 | rs3793467 | 0.51 | 0.766415386 | 0.8689 |
| hCV28008078 | rs4745543 | hCV30586985 | rs10126006 | 0.51 | 0.766415386 | 0.8573 |
| hCV28008078 | rs4745543 | hCV31363797 | rs11145043 | 0.51 | 0.766415386 | 0.792 |
| hCV28008078 | rs4745543 | hCV31363840 | rs7875693 | 0.51 | 0.766415386 | 0.7884 |
| hCV28008078 | rs4745543 | hCV31363841 | rs7849347 | 0.51 | 0.766415386 | 0.8065 |
| hCV28008078 | rs4745543 | hCV31363984 | rs7855905 | 0.51 | 0.766415386 | 0.792 |
| hCV28023091 | rs4908773 | hCV11398434 | rs1812457 | 0.51 | 0.495466362 | 0.7979 |
| hCV28023091 | rs4908773 | hCV11398437 | rs1817367 | 0.51 | 0.495466362 | 0.6548 |
| hCV28023091 | rs4908773 | hCV11675962 | rs10746481 | 0.51 | 0.495466362 | 0.8704 |
| hCV28023091 | rs4908773 | hCV1188659 | rs3820037 | 0.51 | 0.495466362 | 0.5447 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV28023091 | rs4908773 | hCV1188660 | rs6660137 | 0.51 | 0.495466362 | 0.5538 |
| hCV28023091 | rs4908773 | hCV1188664 | rs2765511 | 0.51 | 0.495466362 | 0.6126 |
| hCV28023091 | rs4908773 | hCV1188665 | rs2781060 | 0.51 | 0.495466362 | 0.6354 |
| hCV28023091 | rs4908773 | hCV1188676 | rs11121247 | 0.51 | 0.495466362 | 0.5538 |
| hCV28023091 | rs4908773 | hCV1188731 | rs4908514 | 0.51 | 0.495466362 | 1 |
| hCV28023091 | rs4908773 | hCV1188735 | rs10864366 | 0.51 | 0.495466362 | 1 |
| hCV28023091 | rs4908773 | hCV12040675 | rs2038904 | 0.51 | 0.495466362 | 0.6126 |
| hCV28023091 | rs4908773 | hCV15882429 | rs2289732 | 0.51 | 0.495466362 | 0.6247 |
| hCV28023091 | rs4908773 | hCV15932991 | rs2781067 | 0.51 | 0.495466362 | 0.6188 |
| hCV28023091 | rs4908773 | hCV15932992 | rs2781068 | 0.51 | 0.495466362 | 0.6121 |
| hCV28023091 | rs4908773 | hCV27157507 | rs6664000 | 0.51 | 0.495466362 | 1 |
| hCV28023091 | rs4908773 | hCV27157524 | rs6577531 | 0.51 | 0.495466362 | 0.9314 |
| hCV28023091 | rs4908773 | hCV2741759 | rs11121179 | 0.51 | 0.495466362 | 0.6713 |
| hCV28023091 | rs4908773 | hCV27474399 | rs3753275 | 0.51 | 0.495466362 | 0.5807 |
| hCV28023091 | rs4908773 | hCV27884601 | rs4908776 | 0.51 | 0.495466362 | 1 |
| hCV28023091 | rs4908773 | hCV27958354 | rs4908762 | 0.51 | 0.495466362 | 0.6717 |
| hCV28023091 | rs4908773 | hCV29368919 | rs4908513 | 0.51 | 0.495466362 | 1 |
| hCV28023091 | rs4908773 | hCV2943451 | rs902355 | 0.51 | 0.495466362 | 0.7098 |
| hCV28023091 | rs4908773 | hCV2943853 | rs301793 | 0.51 | 0.495466362 | 0.6247 |
| hCV28023091 | rs4908773 | hCV2966436 | rs11121174 | 0.51 | 0.495466362 | 0.6247 |
| hCV28023091 | rs4908773 | hCV2966437 | rs11580417 | 0.51 | 0.495466362 | 0.6247 |
| hCV28023091 | rs4908773 | hCV2966441 | rs6684863 | 0.51 | 0.495466362 | 0.6247 |
| hCV28023091 | rs4908773 | hCV2966444 | rs11121171 | 0.51 | 0.495466362 | 0.6727 |
| hCV28023091 | rs4908773 | hCV29819064 | rs6698079 | 0.51 | 0.495466362 | 0.7458 |
| hCV28023091 | rs4908773 | hCV2987250 | rs301810 | 0.51 | 0.495466362 | 0.5105 |
| hCV28023091 | rs4908773 | hCV29873524 | rs7533113 | 0.51 | 0.495466362 | 1 |
| hCV28023091 | rs4908773 | hCV29873526 | rs6697997 | 0.51 | 0.495466362 | 0.6952 |
| hCV28023091 | rs4908773 | hCV29945430 | rs7517436 | 0.51 | 0.495466362 | 1 |
| hCV28023091 | rs4908773 | hCV30035535 | rs7518204 | 0.51 | 0.495466362 | 1 |
| hCV28023091 | rs4908773 | hCV30125699 | rs4581300 | 0.51 | 0.495466362 | 0.6067 |
| hCV28023091 | rs4908773 | hCV30143725 | rs6690050 | 0.51 | 0.495466362 | 0.7437 |
| hCV28023091 | rs4908773 | hCV30467730 | rs6702457 | 0.51 | 0.495466362 | 0.8704 |
| hCV28023091 | rs4908773 | hCV3086930 | rs6658881 | 0.51 | 0.495466362 | 0.8213 |
| hCV28023091 | rs4908773 | hCV3086932 | rs7533442 | 0.51 | 0.495466362 | 0.8213 |
| hCV28023091 | rs4908773 | hCV3086950 | rs4908771 | 0.51 | 0.495466362 | 0.8704 |
| hCV28023091 | rs4908773 | hCV3086961 | rs6703577 | 0.51 | 0.495466362 | 0.7188 |
| hCV28023091 | rs4908773 | hCV3086971 | rs6679948 | 0.51 | 0.495466362 | 0.7979 |
| hCV28023091 | rs4908773 | hCV3086972 | rs6688329 | 0.51 | 0.495466362 | 0.8568 |
| hCV28023091 | rs4908773 | hCV3086998 | rs7530863 | 0.51 | 0.495466362 | 0.6717 |
| hCV28023091 | rs4908773 | hCV3087000 | rs1463055 | 0.51 | 0.495466362 | 0.6952 |
| hCV28023091 | rs4908773 | hCV3087003 | rs6577500 | 0.51 | 0.495466362 | 0.6952 |
| hCV28023091 | rs4908773 | hCV3087015 | rs11121198 | 0.51 | 0.495466362 | 0.6952 |
| hCV28023091 | rs4908773 | hCV3087016 | rs2297867 | 0.51 | 0.495466362 | 0.6499 |
| hCV28023091 | rs4908773 | hCV32055284 | rs12079653 | 0.51 | 0.495466362 | 0.6676 |
| hCV28023091 | rs4908773 | hCV32055470 | rs6577506 | 0.51 | 0.495466362 | 0.7188 |
| hCV28023091 | rs4908773 | hCV32055474 | rs10864359 | 0.51 | 0.495466362 | 0.6717 |
| hCV28023091 | rs4908773 | hCV32055477 | rs10779705 | 0.51 | 0.495466362 | 0.7979 |
| hCV28023091 | rs4908773 | hCV32055527 | rs10864364 | 0.51 | 0.495466362 | 1 |
| hCV28023091 | rs4908773 | hCV32055548 | rs11121197 | 0.51 | 0.495466362 | 0.6952 |
| hCV28023091 | rs4908773 | hCV32055579 | rs6577522 | 0.51 | 0.495466362 | 1 |
| hCV28023091 | rs4908773 | hCV32055595 | rs6577524 | 0.51 | 0.495466362 | 1 |
| hCV28023091 | rs4908773 | hCV32055596 | rs6577525 | 0.51 | 0.495466362 | 1 |
| hCV28023091 | rs4908773 | hCV32055625 | rs6678590 | 0.51 | 0.495466362 | 0.8645 |
| hCV28023091 | rs4908773 | hCV32055637 | rs6577532 | 0.51 | 0.495466362 | 0.8301 |
| hCV28023091 | rs4908773 | hCV32055662 | rs6677249 | 0.51 | 0.495466362 | 0.645 |
| hCV28023091 | rs4908773 | hCV32055677 | rs10864355 | 0.51 | 0.495466362 | 0.6952 |
| hCV28023091 | rs4908773 | hCV529178 | rs301811 | 0.51 | 0.495466362 | 0.6949 |
| hCV28023091 | rs4908773 | hCV529182 | rs301800 | 0.51 | 0.495466362 | 0.6998 |
| hCV28023091 | rs4908773 | hCV597227 | rs301809 | 0.51 | 0.495466362 | 0.6952 |
| hCV28023091 | rs4908773 | hCV597229 | rs301785 | 0.51 | 0.495466362 | 0.6952 |
| hCV28023091 | rs4908773 | hCV877241 | rs301788 | 0.51 | 0.495466362 | 0.6713 |
| hCV28023091 | rs4908773 | hCV8823713 | rs1472228 | 0.51 | 0.495466362 | 1 |
| hCV28023091 | rs4908773 | hCV8824244 | rs1006950 | 0.51 | 0.495466362 | 0.574 |
| hCV28023091 | rs4908773 | hCV8824248 | rs1543711 | 0.51 | 0.495466362 | 0.6126 |
| hCV28023091 | rs4908773 | hCV8824288 | rs910582 | 0.51 | 0.495466362 | 0.6952 |
| hCV28023091 | rs4908773 | hCV8824394 | rs1443929 | 0.51 | 0.495466362 | 0.6713 |
| hCV28023091 | rs4908773 | hCV8824424 | rs1058790 | 0.51 | 0.495466362 | 0.6727 |
| hCV28023091 | rs4908773 | hCV8824425 | rs1058791 | 0.51 | 0.495466362 | 0.6383 |
| hCV28023091 | rs4908773 | hCV8881145 | rs1038008 | 0.51 | 0.495466362 | 0.7979 |
| hCV28023091 | rs4908773 | hCV8881146 | rs1463054 | 0.51 | 0.495466362 | 0.8032 |
| hCV28023091 | rs4908773 | hCV8881157 | rs1535158 | 0.51 | 0.495466362 | 0.7979 |
| hCV28023091 | rs4908773 | hCV8881161 | rs926951 | 0.51 | 0.495466362 | 0.6717 |
| hCV282793 | rs11751605 | hCV30977815 | rs3127597 | 0.51 | 0.782580889 | 0.801 |
| hCV28960526 | rs6853079 | hCV28960525 | rs6532740 | 0.51 | 0.9 | 1 |
| hCV28960526 | rs6853079 | hCV29480044 | rs10516433 | 0.51 | 0.9 | 1 |
| hCV28960526 | rs6853079 | hCV30454150 | rs10516434 | 0.51 | 0.9 | 0.9309 |
| hCV28960526 | rs6853079 | hCV30694936 | rs6840610 | 0.51 | 0.9 | 1 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV28960526 | rs6853079 | hDV70961198 | rs17498778 | 0.51 | 0.9 | 1 |
| hCV28960526 | rs6853079 | hDV70961229 | rs17499015 | 0.51 | 0.9 | 0.9398 |
| hCV28960526 | rs6853079 | hDV70969482 | rs17564872 | 0.51 | 0.9 | 1 |
| hCV28960526 | rs6853079 | hDV71951446 | rs7689289 | 0.51 | 0.9 | 1 |
| hCV28974083 | rs8032553 | hCV26066881 | rs11629584 | 0.51 | 0.9 | 1 |
| hCV28974083 | rs8032553 | hCV30732106 | rs4556765 | 0.51 | 0.9 | 0.9647 |
| hCV28974083 | rs8032553 | hCV31590435 | rs11634571 | 0.51 | 0.9 | 0.9634 |
| hCV29011391 | rs7557067 | hCV11168524 | rs6544366 | 0.51 | 0.9 | 1 |
| hCV29011391 | rs7557067 | hCV11168530 | rs6728178 | 0.51 | 0.9 | 1 |
| hCV29011391 | rs7557067 | hCV260164 | rs6754295 | 0.51 | 0.9 | 1 |
| hCV29011391 | rs7557067 | hCV27912761 | rs4564803 | 0.51 | 0.9 | 1 |
| hCV29011391 | rs7557067 | hCV30455594 | rs10184054 | 0.51 | 0.9 | 1 |
| hCV29011391 | rs7557067 | hCV30847428 | rs11902417 | 0.51 | 0.9 | 1 |
| hCV29135108 | rs6743779 | hCV2772191 | rs10170608 | 0.51 | 0.9 | 0.9005 |
| hCV2932115 | rs5517 | hCV1531092 | rs3745522 | 0.51 | 0.9 | 0.9476 |
| hCV2932115 | rs5517 | hCV29188580 | rs3212820 | 0.51 | 0.9 | 1 |
| hCV2932115 | rs5517 | hCV2932116 | rs5519 | 0.51 | 0.9 | 1 |
| hCV29322781 | rs6921516 | hCV103951 | rs6455688 | 0.51 | 0.465336662 | 0.9792 |
| hCV29322781 | rs6921516 | hCV103951 | rs6455688 | 0.51 | 0.622712349 | 0.9792 |
| hCV29322781 | rs6921516 | hCV103952 | rs6923877 | 0.51 | 0.465336662 | 0.9792 |
| hCV29322781 | rs6921516 | hCV103952 | rs6923877 | 0.51 | 0.622712349 | 0.9792 |
| hCV29322781 | rs6921516 | hCV11226249 | rs6415085 | 0.51 | 0.465336662 | 0.7601 |
| hCV29322781 | rs6921516 | hCV11226249 | rs6415085 | 0.51 | 0.622712349 | 0.7601 |
| hCV29322781 | rs6921516 | hCV11284288 | rs9457946 | 0.51 | 0.465336662 | 1 |
| hCV29322781 | rs6921516 | hCV11284288 | rs9457946 | 0.51 | 0.622712349 | 1 |
| hCV29322781 | rs6921516 | hCV11846435 | rs6929299 | 0.51 | 0.465336662 | 0.8326 |
| hCV29322781 | rs6921516 | hCV11846435 | rs6929299 | 0.51 | 0.622712349 | 0.8326 |
| hCV29322781 | rs6921516 | hCV1550866 | rs6932014 | 0.51 | 0.465336662 | 0.7601 |
| hCV29322781 | rs6921516 | hCV1550866 | rs6932014 | 0.51 | 0.622712349 | 0.7601 |
| hCV29322781 | rs6921516 | hCV1550871 | rs9355295 | 0.51 | 0.465336662 | 1 |
| hCV29322781 | rs6921516 | hCV1550871 | rs9355295 | 0.51 | 0.622712349 | 1 |
| hCV29322781 | rs6921516 | hCV207123 | rs7771801 | 0.51 | 0.465336662 | 1 |
| hCV29322781 | rs6921516 | hCV207123 | rs7771801 | 0.51 | 0.622712349 | 1 |
| hCV29322781 | rs6921516 | hCV207127 | rs7453899 | 0.51 | 0.465336662 | 0.9795 |
| hCV29322781 | rs6921516 | hCV207127 | rs7453899 | 0.51 | 0.622712349 | 0.9795 |
| hCV29322781 | rs6921516 | hCV207128 | rs6455689 | 0.51 | 0.465336662 | 0.9184 |
| hCV29322781 | rs6921516 | hCV207128 | rs6455689 | 0.51 | 0.622712349 | 0.9184 |
| hCV29322781 | rs6921516 | hCV243055 | rs10945682 | 0.51 | 0.465336662 | 0.8334 |
| hCV29322781 | rs6921516 | hCV243055 | rs10945682 | 0.51 | 0.622712349 | 0.8334 |
| hCV29322781 | rs6921516 | hCV249895 | rs7771129 | 0.51 | 0.465336662 | 0.7601 |
| hCV29322781 | rs6921516 | hCV249895 | rs7771129 | 0.51 | 0.622712349 | 0.7601 |
| hCV29322781 | rs6921516 | hCV249897 | rs6913833 | 0.51 | 0.465336662 | 0.6796 |
| hCV29322781 | rs6921516 | hCV249897 | rs6913833 | 0.51 | 0.622712349 | 0.6796 |
| hCV29322781 | rs6921516 | hCV249898 | rs9456552 | 0.51 | 0.465336662 | 0.7704 |
| hCV29322781 | rs6921516 | hCV249898 | rs9456552 | 0.51 | 0.622712349 | 0.7704 |
| hCV29322781 | rs6921516 | hCV25929408 | rs7765781 | 0.51 | 0.465336662 | 1 |
| hCV29322781 | rs6921516 | hCV25929408 | rs7765781 | 0.51 | 0.622712349 | 1 |
| hCV29322781 | rs6921516 | hCV25929478 | rs7765803 | 0.51 | 0.465336662 | 0.9795 |
| hCV29322781 | rs6921516 | hCV25929478 | rs7765803 | 0.51 | 0.622712349 | 0.9795 |
| hCV29322781 | rs6921516 | hCV26272389 | rs7760585 | 0.51 | 0.465336662 | 0.8334 |
| hCV29322781 | rs6921516 | hCV26272389 | rs7760585 | 0.51 | 0.622712349 | 0.8334 |
| hCV29322781 | rs6921516 | hCV27422546 | rs7761377 | 0.51 | 0.465336662 | 0.722 |
| hCV29322781 | rs6921516 | hCV27422546 | rs7761377 | 0.51 | 0.622712349 | 0.722 |
| hCV29322781 | rs6921516 | hCV27422547 | rs6455696 | 0.51 | 0.465336662 | 0.7271 |
| hCV29322781 | rs6921516 | hCV27422547 | rs6455696 | 0.51 | 0.622712349 | 0.7271 |
| hCV29322781 | rs6921516 | hCV27422554 | rs6923917 | 0.51 | 0.465336662 | 0.8334 |
| hCV29322781 | rs6921516 | hCV27422554 | rs6923917 | 0.51 | 0.622712349 | 0.8334 |
| hCV29322781 | rs6921516 | hCV27422556 | rs9355814 | 0.51 | 0.465336662 | 0.7413 |
| hCV29322781 | rs6921516 | hCV27422556 | rs9355814 | 0.51 | 0.622712349 | 0.7413 |
| hCV29322781 | rs6921516 | hCV27422557 | rs9355813 | 0.51 | 0.465336662 | 0.767 |
| hCV29322781 | rs6921516 | hCV27422557 | rs9355813 | 0.51 | 0.622712349 | 0.767 |
| hCV29322781 | rs6921516 | hCV27422575 | rs6415084 | 0.51 | 0.465336662 | 0.4788 |
| hCV29322781 | rs6921516 | hCV29546641 | rs9365171 | 0.51 | 0.465336662 | 0.8819 |
| hCV29322781 | rs6921516 | hCV29546641 | rs9365171 | 0.51 | 0.622712349 | 0.8819 |
| hCV29322781 | rs6921516 | hCV29709361 | rs9365179 | 0.51 | 0.465336662 | 0.8171 |
| hCV29322781 | rs6921516 | hCV29709361 | rs9365179 | 0.51 | 0.622712349 | 0.8171 |
| hCV29322781 | rs6921516 | hCV29817515 | rs9355817 | 0.51 | 0.465336662 | 0.6883 |
| hCV29322781 | rs6921516 | hCV29817515 | rs9355817 | 0.51 | 0.622712349 | 0.6883 |
| hCV29322781 | rs6921516 | hCV29934611 | rs9295130 | 0.51 | 0.465336662 | 0.8152 |
| hCV29322781 | rs6921516 | hCV29934611 | rs9295130 | 0.51 | 0.622712349 | 0.8152 |
| hCV29322781 | rs6921516 | hCV29998162 | rs9457943 | 0.51 | 0.465336662 | 1 |
| hCV29322781 | rs6921516 | hCV29998162 | rs9457943 | 0.51 | 0.622712349 | 1 |
| hCV29322781 | rs6921516 | hCV305046 | rs6902102 | 0.51 | 0.465336662 | 0.7529 |
| hCV29322781 | rs6921516 | hCV305046 | rs6902102 | 0.51 | 0.622712349 | 0.7529 |
| hCV29322781 | rs6921516 | hCV30574599 | rs7770628 | 0.51 | 0.465336662 | 0.4698 |
| hCV29322781 | rs6921516 | hCV3201494 | rs1367209 | 0.51 | 0.465336662 | 0.7291 |
| hCV29322781 | rs6921516 | hCV3201494 | rs1367209 | 0.51 | 0.622712349 | 0.7291 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV29322781 | rs6921516 | hCV3201497 | rs1321196 | 0.51 | 0.465336662 | 0.8334 |
| hCV29322781 | rs6921516 | hCV3201497 | rs1321196 | 0.51 | 0.622712349 | 0.8334 |
| hCV29322781 | rs6921516 | hCV8710154 | rs1569933 | 0.51 | 0.465336662 | 0.8274 |
| hCV29322781 | rs6921516 | hCV8710154 | rs1569933 | 0.51 | 0.622712349 | 0.8274 |
| hCV29322781 | rs6921516 | hCV8710161 | rs1740428 | 0.51 | 0.465336662 | 0.8334 |
| hCV29322781 | rs6921516 | hCV8710161 | rs1740428 | 0.51 | 0.622712349 | 0.8334 |
| hCV29322781 | rs6921516 | hCV8710162 | rs1367211 | 0.51 | 0.465336662 | 0.7291 |
| hCV29322781 | rs6921516 | hCV8710162 | rs1367211 | 0.51 | 0.622712349 | 0.7291 |
| hCV29322781 | rs6921516 | hDV77235995 | rs7746273 | 0.51 | 0.465336662 | 0.6915 |
| hCV29322781 | rs6921516 | hDV77235995 | rs7746273 | 0.51 | 0.622712349 | 0.6915 |
| hCV29368919 | rs4908513 | hCV11398434 | rs1812457 | 0.51 | 0.496733059 | 0.8094 |
| hCV29368919 | rs4908513 | hCV11398437 | rs1817367 | 0.51 | 0.496733059 | 0.7755 |
| hCV29368919 | rs4908513 | hCV11675962 | rs10746481 | 0.51 | 0.496733059 | 0.8774 |
| hCV29368919 | rs4908513 | hCV1188659 | rs3820037 | 0.51 | 0.496733059 | 0.5968 |
| hCV29368919 | rs4908513 | hCV1188660 | rs6660137 | 0.51 | 0.496733059 | 0.6126 |
| hCV29368919 | rs4908513 | hCV1188664 | rs2765511 | 0.51 | 0.496733059 | 0.6312 |
| hCV29368919 | rs4908513 | hCV1188665 | rs2781060 | 0.51 | 0.496733059 | 0.6541 |
| hCV29368919 | rs4908513 | hCV1188676 | rs11121247 | 0.51 | 0.496733059 | 0.6126 |
| hCV29368919 | rs4908513 | hCV1188731 | rs4908514 | 0.51 | 0.496733059 | 1 |
| hCV29368919 | rs4908513 | hCV1188735 | rs10864366 | 0.51 | 0.496733059 | 1 |
| hCV29368919 | rs4908513 | hCV12040675 | rs2038904 | 0.51 | 0.496733059 | 0.6312 |
| hCV29368919 | rs4908513 | hCV15882429 | rs2289732 | 0.51 | 0.496733059 | 0.6452 |
| hCV29368919 | rs4908513 | hCV15932991 | rs2781067 | 0.51 | 0.496733059 | 0.6396 |
| hCV29368919 | rs4908513 | hCV15932992 | rs2781068 | 0.51 | 0.496733059 | 0.6308 |
| hCV29368919 | rs4908513 | hCV27157507 | rs6664000 | 0.51 | 0.496733059 | 1 |
| hCV29368919 | rs4908513 | hCV27157524 | rs6577531 | 0.51 | 0.496733059 | 0.9353 |
| hCV29368919 | rs4908513 | hCV27157546 | rs11811795 | 0.51 | 0.496733059 | 0.5453 |
| hCV29368919 | rs4908513 | hCV27157560 | rs11121252 | 0.51 | 0.496733059 | 0.5135 |
| hCV29368919 | rs4908513 | hCV2741759 | rs11121179 | 0.51 | 0.496733059 | 0.6247 |
| hCV29368919 | rs4908513 | hCV27884601 | rs4908776 | 0.51 | 0.496733059 | 1 |
| hCV29368919 | rs4908513 | hCV27958354 | rs4908762 | 0.51 | 0.496733059 | 0.6952 |
| hCV29368919 | rs4908513 | hCV28023091 | rs4908773 | 0.51 | 0.496733059 | 1 |
| hCV29368919 | rs4908513 | hCV2943451 | rs902355 | 0.51 | 0.496733059 | 0.7273 |
| hCV29368919 | rs4908513 | hCV2943853 | rs301793 | 0.51 | 0.496733059 | 0.6452 |
| hCV29368919 | rs4908513 | hCV2966436 | rs11121174 | 0.51 | 0.496733059 | 0.6452 |
| hCV29368919 | rs4908513 | hCV2966437 | rs11580417 | 0.51 | 0.496733059 | 0.6452 |
| hCV29368919 | rs4908513 | hCV2966441 | rs6684863 | 0.51 | 0.496733059 | 0.6452 |
| hCV29368919 | rs4908513 | hCV2966444 | rs11121171 | 0.51 | 0.496733059 | 0.6911 |
| hCV29368919 | rs4908513 | hCV29819064 | rs6698079 | 0.51 | 0.496733059 | 0.7479 |
| hCV29368919 | rs4908513 | hCV2987250 | rs301810 | 0.51 | 0.496733059 | 0.5341 |
| hCV29368919 | rs4908513 | hCV29873524 | rs7533113 | 0.51 | 0.496733059 | 1 |
| hCV29368919 | rs4908513 | hCV29873526 | rs6697997 | 0.51 | 0.496733059 | 0.7112 |
| hCV29368919 | rs4908513 | hCV29945430 | rs7517436 | 0.51 | 0.496733059 | 1 |
| hCV29368919 | rs4908513 | hCV30035535 | rs7518204 | 0.51 | 0.496733059 | 1 |
| hCV29368919 | rs4908513 | hCV30125699 | rs4581300 | 0.51 | 0.496733059 | 0.6952 |
| hCV29368919 | rs4908513 | hCV30143725 | rs6690050 | 0.51 | 0.496733059 | 0.7577 |
| hCV29368919 | rs4908513 | hCV30467730 | rs6702457 | 0.51 | 0.496733059 | 0.8774 |
| hCV29368919 | rs4908513 | hCV3086930 | rs6658881 | 0.51 | 0.496733059 | 0.8704 |
| hCV29368919 | rs4908513 | hCV3086932 | rs7533442 | 0.51 | 0.496733059 | 0.8704 |
| hCV29368919 | rs4908513 | hCV3086950 | rs4908771 | 0.51 | 0.496733059 | 0.8774 |
| hCV29368919 | rs4908513 | hCV3086961 | rs6703577 | 0.51 | 0.496733059 | 0.7979 |
| hCV29368919 | rs4908513 | hCV3086971 | rs6679948 | 0.51 | 0.496733059 | 0.8094 |
| hCV29368919 | rs4908513 | hCV3086972 | rs6688329 | 0.51 | 0.496733059 | 0.8654 |
| hCV29368919 | rs4908513 | hCV3086998 | rs7530863 | 0.51 | 0.496733059 | 0.6952 |
| hCV29368919 | rs4908513 | hCV3087000 | rs1463055 | 0.51 | 0.496733059 | 0.7112 |
| hCV29368919 | rs4908513 | hCV3087003 | rs6577500 | 0.51 | 0.496733059 | 0.7112 |
| hCV29368919 | rs4908513 | hCV3087015 | rs11121198 | 0.51 | 0.496733059 | 0.7112 |
| hCV29368919 | rs4908513 | hCV3087016 | rs2297867 | 0.51 | 0.496733059 | 0.6952 |
| hCV29368919 | rs4908513 | hCV32055284 | rs12079653 | 0.51 | 0.496733059 | 0.6858 |
| hCV29368919 | rs4908513 | hCV32055470 | rs6577506 | 0.51 | 0.496733059 | 0.7979 |
| hCV29368919 | rs4908513 | hCV32055474 | rs10864359 | 0.51 | 0.496733059 | 0.7979 |
| hCV29368919 | rs4908513 | hCV32055477 | rs10779705 | 0.51 | 0.496733059 | 0.8094 |
| hCV29368919 | rs4908513 | hCV32055527 | rs10864364 | 0.51 | 0.496733059 | 1 |
| hCV29368919 | rs4908513 | hCV32055548 | rs11121197 | 0.51 | 0.496733059 | 0.7112 |
| hCV29368919 | rs4908513 | hCV32055579 | rs6577522 | 0.51 | 0.496733059 | 1 |
| hCV29368919 | rs4908513 | hCV32055595 | rs6577524 | 0.51 | 0.496733059 | 1 |
| hCV29368919 | rs4908513 | hCV32055596 | rs6577525 | 0.51 | 0.496733059 | 1 |
| hCV29368919 | rs4908513 | hCV32055625 | rs6678590 | 0.51 | 0.496733059 | 0.879 |
| hCV29368919 | rs4908513 | hCV32055637 | rs6577532 | 0.51 | 0.496733059 | 0.9314 |
| hCV29368919 | rs4908513 | hCV32055662 | rs6677249 | 0.51 | 0.496733059 | 0.7437 |
| hCV29368919 | rs4908513 | hCV32055677 | rs10864355 | 0.51 | 0.496733059 | 0.7112 |
| hCV29368919 | rs4908513 | hCV529178 | rs301811 | 0.51 | 0.496733059 | 0.7109 |
| hCV29368919 | rs4908513 | hCVS29182 | rs301800 | 0.51 | 0.496733059 | 0.6732 |
| hCV29368919 | rs4908513 | hCV597227 | rs301809 | 0.51 | 0.496733059 | 0.7112 |
| hCV29368919 | rs4908513 | hCV597229 | rs301785 | 0.51 | 0.496733059 | 0.7112 |
| hCV29368919 | rs4908513 | hCV877241 | rs301788 | 0.51 | 0.496733059 | 0.6247 |
| hCV29368919 | rs4908513 | hCV8823713 | rs1472228 | 0.51 | 0.496733059 | 1 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV29368919 | rs4908513 | hCV8824241 | rs1325920 | 0.51 | 0.496733059 | 0.5423 |
| hCV29368919 | rs4908513 | hCV8824244 | rs1006950 | 0.51 | 0.496733059 | 0.6126 |
| hCV29368919 | rs4908513 | hCV8824248 | rs1543711 | 0.51 | 0.496733059 | 0.6312 |
| hCV29368919 | rs4908513 | hCV8824288 | rs910582 | 0.51 | 0.496733059 | 0.7112 |
| hCV29368919 | rs4908513 | hCV8824394 | rs1443929 | 0.51 | 0.496733059 | 0.6247 |
| hCV29368919 | rs4908513 | hCV8824424 | rs1058790 | 0.51 | 0.496733059 | 0.6911 |
| hCV29368919 | rs4908513 | hCV8824425 | rs1058791 | 0.51 | 0.496733059 | 0.6721 |
| hCV29368919 | rs4908513 | hCV8881145 | rs1038008 | 0.51 | 0.496733059 | 0.8094 |
| hCV29368919 | rs4908513 | hCV8881146 | rs1463054 | 0.51 | 0.496733059 | 0.8042 |
| hCV29368919 | rs4908513 | hCV8881157 | rs1535158 | 0.51 | 0.496733059 | 0.8094 |
| hCV29368919 | rs4908513 | hCV8881161 | rs926951 | 0.51 | 0.496733059 | 0.6952 |
| hCV29480044 | rs10516433 | hCV28960525 | rs6532740 | 0.51 | 0.9 | 1 |
| hCV29480044 | rs10516433 | hCV28960526 | rs6853079 | 0.51 | 0.9 | 1 |
| hCV29480044 | rs10516433 | hCV30454150 | rs10516434 | 0.51 | 0.9 | 0.9309 |
| hCV29480044 | rs10516433 | hCV30694936 | rs6840610 | 0.51 | 0.9 | 1 |
| hCV29480044 | rs10516433 | hDV70961198 | rs17498778 | 0.51 | 0.9 | 1 |
| hCV29480044 | rs10516433 | hDV70961229 | rs17499015 | 0.51 | 0.9 | 0.9398 |
| hCV29480044 | rs10516433 | hDV70969482 | rs17564872 | 0.51 | 0.9 | 1 |
| hCV29480044 | rs10516433 | hDV71951446 | rs7689289 | 0.51 | 0.9 | 1 |
| hCV2960489 | rs3785889 | hCV10293 | rs3851786 | 0.51 | 0.784117293 | 0.8104 |
| hCV2960489 | rs3785889 | hCV11623025 | rs9898981 | 0.51 | 0.784117293 | 0.8121 |
| hCV2960489 | rs3785889 | hCV11623029 | rs2316330 | 0.51 | 0.784117293 | 0.8195 |
| hCV2960489 | rs3785889 | hCV2275283 | rs740617 | 0.51 | 0.784117293 | 0.7937 |
| hCV2960489 | rs3785889 | hCV2592671 | rs197926 | 0.51 | 0.784117293 | 0.8209 |
| hCV2960489 | rs3785889 | hCV2592673 | rs4968286 | 0.51 | 0.784117293 | 0.8591 |
| hCV2960489 | rs3785889 | hCV2592677 | rs736604 | 0.51 | 0.784117293 | 0.8209 |
| hCV2960489 | rs3785889 | hCV2592681 | rs17608961 | 0.51 | 0.784117293 | 0.8586 |
| hCV2960489 | rs3785889 | hCV26660327 | rs11869840 | 0.51 | 0.784117293 | 0.8578 |
| hCV2960489 | rs3785889 | hCV29195266 | rs3809854 | 0.51 | 0.784117293 | 0.8209 |
| hCV2960489 | rs3785889 | hCV2959464 | rs3760377 | 0.51 | 0.784117293 | 0.8591 |
| hCV2960489 | rs3785889 | hCV2959466 | rs6504622 | 0.51 | 0.784117293 | 0.8591 |
| hCV2960489 | rs3785889 | hCV30299603 | rs9889762 | 0.51 | 0.784117293 | 0.8398 |
| hCV2960489 | rs3785889 | hCV31466218 | rs11079745 | 0.51 | 0.784117293 | 0.8586 |
| hCV2960489 | rs3785889 | hCV31466219 | rs11652318 | 0.51 | 0.784117293 | 0.8195 |
| hCV2960489 | rs3785889 | hCV7448063 | rs736603 | 0.51 | 0.784117293 | 0.816 |
| hCV2960489 | rs3785889 | hCV7451199 | rs3851785 | 0.51 | 0.784117293 | 0.8195 |
| hCV2960489 | rs3785889 | hCV7451217 | rs1052586 | 0.51 | 0.784117293 | 0.8398 |
| hCV29684678 | rs10486788 | hCV11811746 | rs12669397 | 0.51 | 0.9 | 0.9583 |
| hCV29684678 | rs10486788 | hCV2641110 | rs6948282 | 0.51 | 0.9 | 0.9783 |
| hCV29684678 | rs10486788 | hCV2641111 | rs13239842 | 0.51 | 0.9 | 0.9783 |
| hCV29684678 | rs10486788 | hCV2641141 | rs13236237 | 0.51 | 0.9 | 0.9583 |
| hCV29684678 | rs10486788 | hCV2641147 | rs13234986 | 0.51 | 0.9 | 1 |
| hCV29684678 | rs10486788 | hCV2641150 | rs17169192 | 0.51 | 0.9 | 1 |
| hCV29684678 | rs10486788 | hCV26518087 | rs12699759 | 0.51 | 0.9 | 0.9783 |
| hCV29684678 | rs10486788 | hCV31310415 | rs12674430 | 0.51 | 0.9 | 1 |
| hCV29684678 | rs10486788 | hCV31310435 | rs10950592 | 0.51 | 0.9 | 0.9184 |
| hCV29684678 | rs10486788 | hCV31310483 | rs13230922 | 0.51 | 0.9 | 0.919 |
| hCV29684678 | rs10486788 | hCV7603468 | rs1299916 | 0.51 | 0.9 | 1 |
| hCV29684678 | rs10486788 | hDV70913803 | rs17169201 | 0.51 | 0.9 | 1 |
| hCV29819064 | rs6698079 | hCV11398434 | rs1812457 | 0.51 | 0.900593335 | 1 |
| hCV29819064 | rs6698079 | hCV11398437 | rs1817367 | 0.51 | 0.900593335 | 1 |
| hCV29819064 | rs6698079 | hCV11675962 | rs10746481 | 0.51 | 0.900593335 | 0.919 |
| hCV29819064 | rs6698079 | hCV30143725 | rs6690050 | 0.51 | 0.900593335 | 0.919 |
| hCV29819064 | rs6698079 | hCV30467730 | rs6702457 | 0.51 | 0.900593335 | 0.919 |
| hCV29819064 | rs6698079 | hCV3086930 | rs6658881 | 0.51 | 0.900593335 | 0.9184 |
| hCV29819064 | rs6698079 | hCV3086932 | rs7533442 | 0.51 | 0.900593335 | 0.9184 |
| hCV29819064 | rs6698079 | hCV3086950 | rs4908771 | 0.51 | 0.900593335 | 0.919 |
| hCV29819064 | rs6698079 | hCV3086961 | rs6703577 | 0.51 | 0.900593335 | 1 |
| hCV29819064 | rs6698079 | hCV3086971 | rs6679948 | 0.51 | 0.900593335 | 1 |
| hCV29819064 | rs6698079 | hCV3086972 | rs6688329 | 0.51 | 0.900593335 | 1 |
| hCV29819064 | rs6698079 | hCV32055470 | rs6577506 | 0.51 | 0.900593335 | 1 |
| hCV29819064 | rs6698079 | hCV32055474 | rs10864359 | 0.51 | 0.900593335 | 1 |
| hCV29819064 | rs6698079 | hCV32055477 | rs10779705 | 0.51 | 0.900593335 | 1 |
| hCV29819064 | rs6698079 | hCV8881145 | rs1038008 | 0.51 | 0.900593335 | 1 |
| hCV29819064 | rs6698079 | hCV8881146 | rs1463054 | 0.51 | 0.900593335 | 1 |
| hCV29819064 | rs6698079 | hCV8881157 | rs1535158 | 0.51 | 0.900593335 | 1 |
| hCV2983035 | rs9527026 | hCV25611075 | rs7997728 | 0.51 | 0.9 | 1 |
| hCV2983035 | rs9527026 | hCV29426416 | rs8000084 | 0.51 | 0.9 | 1 |
| hCV2983035 | rs9527026 | hCV29426417 | rs8001148 | 0.51 | 0.9 | 1 |
| hCV2983035 | rs9527026 | hCV29426429 | rs7986435 | 0.51 | 0.9 | 1 |
| hCV2983035 | rs9527026 | hCV29676871 | rs9527032 | 0.51 | 0.9 | 0.9428 |
| hCV2983035 | rs9527026 | hCV29803144 | rs7982726 | 0.51 | 0.9 | 1 |
| hCV2983035 | rs9527026 | hCV2983036 | rs9527025 | 0.51 | 0.9 | 1 |
| hCV2983035 | rs9527026 | hCV2983037 | rs9536314 | 0.51 | 0.9 | 1 |
| hCV2983035 | rs9527026 | hCV2983038 | rs9536313 | 0.51 | 0.9 | 1 |
| hCV2983035 | rs9527026 | hCV2983040 | rs9527024 | 0.51 | 0.9 | 1 |
| hCV2983035 | rs9527026 | hCV29929821 | rs9536239 | 0.51 | 0.9 | 1 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV2983035 | rs9527026 | hCV30109848 | rs9526990 | 0.51 | 0.9 | 1 |
| hCV2983035 | rs9527026 | hCV30181994 | rs9527022 | 0.51 | 0.9 | 1 |
| hCV2983035 | rs9527026 | hCV30217619 | rs9527023 | 0.51 | 0.9 | 1 |
| hCV2983035 | rs9527026 | hCV30452057 | rs9526992 | 0.51 | 0.9 | 0.9174 |
| hCV2983035 | rs9527026 | hCV30469913 | rs9536234 | 0.51 | 0.9 | 1 |
| hCV2983035 | rs9527026 | hCV30487772 | rs9526998 | 0.51 | 0.9 | 1 |
| hCV2983035 | rs9527026 | hCV30560346 | rs9527021 | 0.51 | 0.9 | 1 |
| hCV2983035 | rs9527026 | hCV32231920 | rs12020187 | 0.51 | 0.9 | 1 |
| hCV2983035 | rs9527026 | hDV72067820 | rs9536282 | 0.51 | 0.9 | 0.9674 |
| hCV2983036 | rs9527025 | hCV25611075 | rs7997728 | 0.51 | 0.9 | 1 |
| hCV2983036 | rs9527025 | hCV29426416 | rs8000084 | 0.51 | 0.9 | 1 |
| hCV2983036 | rs9527025 | hCV29426417 | rs8001148 | 0.51 | 0.9 | 1 |
| hCV2983036 | rs9527025 | hCV29426429 | rs7986435 | 0.51 | 0.9 | 1 |
| hCV2983036 | rs9527025 | hCV29676871 | rs9527032 | 0.51 | 0.9 | 0.9438 |
| hCV2983036 | rs9527025 | hCV29803144 | rs7982726 | 0.51 | 0.9 | 1 |
| hCV2983036 | rs9527025 | hCV2983035 | rs9527026 | 0.51 | 0.9 | 1 |
| hCV2983036 | rs9527025 | hCV2983037 | rs9536314 | 0.51 | 0.9 | 1 |
| hCV2983036 | rs9527025 | hCV2983038 | rs9536313 | 0.51 | 0.9 | 1 |
| hCV2983036 | rs9527025 | hCV2983040 | rs9527024 | 0.51 | 0.9 | 1 |
| hCV2983036 | rs9527025 | hCV29929821 | rs9536239 | 0.51 | 0.9 | 1 |
| hCV2983036 | rs9527025 | hCV30109848 | rs9526990 | 0.51 | 0.9 | 1 |
| hCV2983036 | rs9527025 | hCV30181994 | rs9527022 | 0.51 | 0.9 | 1 |
| hCV2983036 | rs9527025 | hCV30217619 | rs9527023 | 0.51 | 0.9 | 1 |
| hCV2983036 | rs9527025 | hCV30452057 | rs9526992 | 0.51 | 0.9 | 0.9184 |
| hCV2983036 | rs9527025 | hCV30469913 | rs9536234 | 0.51 | 0.9 | 1 |
| hCV2983036 | rs9527025 | hCV30487772 | rs9526998 | 0.51 | 0.9 | 1 |
| hCV2983036 | rs9527025 | hCV30560346 | rs9527021 | 0.51 | 0.9 | 1 |
| hCV2983036 | rs9527025 | hCV32231920 | rs12020187 | 0.51 | 0.9 | 1 |
| hCV2983036 | rs9527025 | hDV72067820 | rs9536282 | 0.51 | 0.9 | 0.9438 |
| hCV2987250 | rs301810 | hCV11398434 | rs1812457 | 0.51 | 0.515143538 | 0.7861 |
| hCV2987250 | rs301810 | hCV11398437 | rs1817367 | 0.51 | 0.515143538 | 0.7562 |
| hCV2987250 | rs301810 | hCV11675962 | rs10746481 | 0.51 | 0.515143538 | 0.7323 |
| hCV2987250 | rs301810 | hCV1188731 | rs4908514 | 0.51 | 0.515143538 | 0.6312 |
| hCV2987250 | rs301810 | hCV15882429 | rs2289732 | 0.51 | 0.515143538 | 0.6324 |
| hCV2987250 | rs301810 | hCV27157507 | rs6664000 | 0.51 | 0.515143538 | 0.6126 |
| hCV2987250 | rs301810 | hCV2741759 | rs11121179 | 0.51 | 0.515143538 | 0.5153 |
| hCV2987250 | rs301810 | hCV27884601 | rs4908776 | 0.51 | 0.515143538 | 0.5328 |
| hCV2987250 | rs301810 | hCV27958354 | rs4908762 | 0.51 | 0.515143538 | 0.8853 |
| hCV2987250 | rs301810 | hCV29368919 | rs4908513 | 0.51 | 0.515143538 | 0.5341 |
| hCV2987250 | rs301810 | hCV2943451 | rs902355 | 0.51 | 0.515143538 | 0.6527 |
| hCV2987250 | rs301810 | hCV2943853 | rs301793 | 0.51 | 0.515143538 | 0.5389 |
| hCV2987250 | rs301810 | hCV2966436 | rs11121174 | 0.51 | 0.515143538 | 0.5389 |
| hCV2987250 | rs301810 | hCV2966437 | rs11580417 | 0.51 | 0.515143538 | 0.6324 |
| hCV2987250 | rs301810 | hCV2966441 | rs6684863 | 0.51 | 0.515143538 | 0.6324 |
| hCV2987250 | rs301810 | hCV2966444 | rs11121171 | 0.51 | 0.515143538 | 0.6809 |
| hCV2987250 | rs301810 | hCV29819064 | rs6698079 | 0.51 | 0.515143538 | 0.7332 |
| hCV2987250 | rs301810 | hCV29873524 | rs7533113 | 0.51 | 0.515143538 | 0.6312 |
| hCV2987250 | rs301810 | hCV29873526 | rs6697997 | 0.51 | 0.515143538 | 0.8909 |
| hCV2987250 | rs301810 | hCV29945430 | rs7517436 | 0.51 | 0.515143538 | 0.6126 |
| hCV2987250 | rs301810 | hCV30035535 | rs7518204 | 0.51 | 0.515143538 | 0.5318 |
| hCV2987250 | rs301810 | hCV301125699 | rs4581300 | 0.51 | 0.515143538 | 0.7731 |
| hCV2987250 | rs301810 | hCV30143725 | rs6690050 | 0.51 | 0.515143538 | 0.7323 |
| hCV2987250 | rs301810 | hCV30467730 | rs6702457 | 0.51 | 0.515143538 | 0.633 |
| hCV2987250 | rs301810 | hCV3086930 | rs6658881 | 0.51 | 0.515143538 | 0.7185 |
| hCV2987250 | rs301810 | hCV3086932 | rs7533442 | 0.51 | 0.515143538 | 0.7185 |
| hCV2987250 | rs301810 | hCV3086950 | rs4908771 | 0.51 | 0.515143538 | 0.7323 |
| hCV2987250 | rs301810 | hCV3086961 | rs6703577 | 0.51 | 0.515143538 | 0.665 |
| hCV2987250 | rs301810 | hCV3086971 | rs6679948 | 0.51 | 0.515143538 | 0.6812 |
| hCV2987250 | rs301810 | hCV3086972 | rs6688329 | 0.51 | 0.515143538 | 0.7073 |
| hCV2987250 | rs301810 | hCV3086998 | rs7530863 | 0.51 | 0.515143538 | 0.8853 |
| hCV2987250 | rs301810 | hCV3087000 | rs1463055 | 0.51 | 0.515143538 | 0.7843 |
| hCV2987250 | rs301810 | hCV3087003 | rs6577500 | 0.51 | 0.515143538 | 0.7843 |
| hCV2987250 | rs301810 | hCV3087015 | rs11121198 | 0.51 | 0.515143538 | 0.8909 |
| hCV2987250 | rs301810 | hCV3087016 | rs2297867 | 0.51 | 0.515143538 | 0.7731 |
| hCV2987250 | rs301810 | hCV32055284 | rs12079653 | 0.51 | 0.515143538 | 0.6533 |
| hCV2987250 | rs301810 | hCV32055470 | rs6577506 | 0.51 | 0.515143538 | 0.7754 |
| hCV2987250 | rs301810 | hCV32055474 | rs10864359 | 0.51 | 0.515143538 | 0.665 |
| hCV2987250 | rs301810 | hCV32055477 | rs10779705 | 0.51 | 0.515143538 | 0.6812 |
| hCV2987250 | rs301810 | hCV32055548 | rs11121197 | 0.51 | 0.515143538 | 0.7843 |
| hCV2987250 | rs301810 | hCV32055579 | rs6577522 | 0.51 | 0.515143538 | 0.6308 |
| hCV2987250 | rs301810 | hCV32055595 | rs6577524 | 0.51 | 0.515143538 | 0.6312 |
| hCV2987250 | rs301810 | hCV32055637 | rs6577532 | 0.51 | 0.515143538 | 0.5618 |
| hCV2987250 | rs301810 | hCV32055677 | rs10864355 | 0.51 | 0.515143538 | 0.7843 |
| hCV2987250 | rs301810 | hCV529178 | rs301811 | 0.51 | 0.515143538 | 0.8909 |
| hCV2987250 | rs301810 | hCV529182 | rs301800 | 0.51 | 0.515143538 | 0.5618 |
| hCV2987250 | rs301810 | hCV597227 | rs301809 | 0.51 | 0.515143538 | 0.8909 |
| hCV2987250 | rs301810 | hCV597229 | rs301785 | 0.51 | 0.515143538 | 0.8909 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV2987250 | rs301810 | hCV877241 | rs301788 | 0.51 | 0.515143538 | 0.6134 |
| hCV2987250 | rs301810 | hCV8823713 | rs1472228 | 0.51 | 0.515143538 | 0.6126 |
| hCV2987250 | rs301810 | hCV8824288 | rs910582 | 0.51 | 0.515143538 | 0.7843 |
| hCV2987250 | rs301810 | hCV8824394 | rs1443929 | 0.51 | 0.515143538 | 0.5153 |
| hCV2987250 | rs301810 | hCV8824424 | rs1058790 | 0.51 | 0.515143538 | 0.5823 |
| hCV2987250 | rs301810 | hCV8824425 | rs1058791 | 0.51 | 0.515143538 | 0.5599 |
| hCV2987250 | rs301810 | hCV8881145 | rs1038008 | 0.51 | 0.515143538 | 0.6812 |
| hCV2987250 | rs301810 | hCV8881146 | rs1463054 | 0.51 | 0.515143538 | 0.7592 |
| hCV2987250 | rs301810 | hCV8881157 | rs1535158 | 0.51 | 0.515143538 | 0.6812 |
| hCV2987250 | rs301810 | hCV8881161 | rs926951 | 0.51 | 0.515143538 | 0.8853 |
| hCV29873524 | rs7533113 | hCV1188731 | rs4908514 | 0.51 | 0.906005924 | 1 |
| hCV29873524 | rs7533113 | hCV1188735 | rs10864366 | 0.51 | 0.906005924 | 1 |
| hCV29873524 | rs7533113 | hCV27157507 | rs6664000 | 0.51 | 0.906005924 | 1 |
| hCV29873524 | rs7533113 | hCV27157524 | rs6577531 | 0.51 | 0.906005924 | 0.9353 |
| hCV29873524 | rs7533113 | hCV27884601 | rs4908776 | 0.51 | 0.906005924 | 1 |
| hCV29873524 | rs7533113 | hCV28023091 | rs4908773 | 0.51 | 0.906005924 | 1 |
| hCV29873524 | rs7533113 | hCV29368919 | rs4908513 | 0.51 | 0.906005924 | 1 |
| hCV29873524 | rs7533113 | hCV29945430 | rs7517436 | 0.51 | 0.906005924 | 1 |
| hCV29873524 | rs7533113 | hCV30035535 | rs7518204 | 0.51 | 0.906005924 | 1 |
| hCV29873524 | rs7533113 | hCV32055527 | rs10864364 | 0.51 | 0.906005924 | 1 |
| hCV29873524 | rs7533113 | hCV32055579 | rs6577522 | 0.51 | 0.906005924 | 1 |
| hCV29873524 | rs7533113 | hCV32055595 | rs6577524 | 0.51 | 0.906005924 | 1 |
| hCV29873524 | rs7533113 | hCV32055596 | rs6577525 | 0.51 | 0.906005924 | 1 |
| hCV29873524 | rs7533113 | hCV32055637 | rs6577532 | 0.51 | 0.906005924 | 0.9314 |
| hCV29873524 | rs7533113 | hCV8823713 | rs1472228 | 0.51 | 0.906005924 | 1 |
| hCV2992252 | rs6037651 | hCV27992218 | rs4813636 | 0.51 | 0.9 | 0.9257 |
| hCV2992252 | rs6037651 | hCV2992258 | rs1018493 | 0.51 | 0.9 | 0.9613 |
| hCV29945430 | rs7517436 | hCV11398434 | rs1812457 | 0.51 | 0.516826964 | 0.7979 |
| hCV29945430 | rs7517436 | hCV11398437 | rs1817367 | 0.51 | 0.516826964 | 0.6548 |
| hCV29945430 | rs7517436 | hCV11675962 | rs10746481 | 0.51 | 0.516826964 | 0.8704 |
| hCV29945430 | rs7517436 | hCV1188659 | rs3820037 | 0.51 | 0.516826964 | 0.5447 |
| hCV29945430 | rs7517436 | hCV1188660 | rs6660137 | 0.51 | 0.516826964 | 0.5538 |
| hCV29945430 | rs7517436 | hCV1188664 | rs2765511 | 0.51 | 0.516826964 | 0.6126 |
| hCV29945430 | rs7517436 | hCV1188665 | rs2781060 | 0.51 | 0.516826964 | 0.6354 |
| hCV29945430 | rs7517436 | hCV1188676 | rs11121247 | 0.51 | 0.516826964 | 0.5538 |
| hCV29945430 | rs7517436 | hCV1188731 | rs4908514 | 0.51 | 0.516826964 | 1 |
| hCV29945430 | rs7517436 | hCV1188735 | rs10864366 | 0.51 | 0.516826964 | 1 |
| hCV29945430 | rs7517436 | hCV12040675 | rs2038904 | 0.51 | 0.516826964 | 0.6126 |
| hCV29945430 | rs7517436 | hCV15882429 | rs2289732 | 0.51 | 0.516826964 | 0.6247 |
| hCV29945430 | rs7517436 | hCV15932991 | rs2781067 | 0.51 | 0.516826964 | 0.6188 |
| hCV29945430 | rs7517436 | hCV15932992 | rs2781068 | 0.51 | 0.516826964 | 0.6121 |
| hCV29945430 | rs7517436 | hCV27157507 | rs6664000 | 0.51 | 0.516826964 | 1 |
| hCV29945430 | rs7517436 | hCV27157524 | rs6577531 | 0.51 | 0.516826964 | 0.9314 |
| hCV29945430 | rs7517436 | hCV2741759 | rs11121179 | 0.51 | 0.516826964 | 0.6713 |
| hCV29945430 | rs7517436 | hCV27474399 | rs3753275 | 0.51 | 0.516826964 | 0.5807 |
| hCV29945430 | rs7517436 | hCV27884601 | rs4908776 | 0.51 | 0.516826964 | 1 |
| hCV29945430 | rs7517436 | hCV27958354 | rs4908762 | 0.51 | 0.516826964 | 0.6717 |
| hCV29945430 | rs7517436 | hCV28023091 | rs4908773 | 0.51 | 0.516826964 | 1 |
| hCV29945430 | rs7517436 | hCV29368919 | rs4908513 | 0.51 | 0.516826964 | 1 |
| hCV29945430 | rs7517436 | hCV2943451 | rs902355 | 0.51 | 0.516826964 | 0.7098 |
| hCV29945430 | rs7517436 | hCV2943853 | rs301793 | 0.51 | 0.516826964 | 0.6247 |
| hCV29945430 | rs7517436 | hCV2966436 | rs11121174 | 0.51 | 0.516826964 | 0.6247 |
| hCV29945430 | rs7517436 | hCV2966437 | rs11580417 | 0.51 | 0.516826964 | 0.6247 |
| hCV29945430 | rs7517436 | hCV2966441 | rs6684863 | 0.51 | 0.516826964 | 0.6247 |
| hCV29945430 | rs7517436 | hCV2966444 | rs11121171 | 0.51 | 0.516826964 | 0.6727 |
| hCV29945430 | rs7517436 | hCV29819064 | rs6698079 | 0.51 | 0.516826964 | 0.7458 |
| hCV29945430 | rs7517436 | hCV2987250 | rs301810 | 0.51 | 0.516826964 | 0.6126 |
| hCV29945430 | rs7517436 | hCV29873524 | rs7533113 | 0.51 | 0.516826964 | 1 |
| hCV29945430 | rs7517436 | hCV29873526 | rs6697997 | 0.51 | 0.516826964 | 0.6952 |
| hCV29945430 | rs7517436 | hCV30035535 | rs7518204 | 0.51 | 0.516826964 | 1 |
| hCV29945430 | rs7517436 | hCV30125699 | rs4581300 | 0.51 | 0.516826964 | 0.6067 |
| hCV29945430 | rs7517436 | hCV30143725 | rs6690050 | 0.51 | 0.516826964 | 0.7437 |
| hCV29945430 | rs7517436 | hCV30467730 | rs6702457 | 0.51 | 0.516826964 | 0.8704 |
| hCV29945430 | rs7517436 | hCV3086930 | rs6658881 | 0.51 | 0.516826964 | 0.8213 |
| hCV29945430 | rs7517436 | hCV3086932 | rs7533442 | 0.51 | 0.516826964 | 0.8213 |
| hCV29945430 | rs7517436 | hCV3086950 | rs4908771 | 0.51 | 0.516826964 | 0.8704 |
| hCV29945430 | rs7517436 | hCV3086961 | rs6703577 | 0.51 | 0.516826964 | 0.7188 |
| hCV29945430 | rs7517436 | hCV3086971 | rs6679948 | 0.51 | 0.516826964 | 0.7979 |
| hCV29945430 | rs7517436 | hCV3086972 | rs6688329 | 0.51 | 0.516826964 | 0.8568 |
| hCV29945430 | rs7517436 | hCV3086998 | rs7530863 | 0.51 | 0.516826964 | 0.6717 |
| hCV29945430 | rs7517436 | hCV3087000 | rs1463055 | 0.51 | 0.516826964 | 0.6952 |
| hCV29945430 | rs7517436 | hCV3087003 | rs6577500 | 0.51 | 0.516826964 | 0.6952 |
| hCV29945430 | rs7517436 | hCV3087015 | rs11121198 | 0.51 | 0.516826964 | 0.6952 |
| hCV29945430 | rs7517436 | hCV3087016 | rs2297867 | 0.51 | 0.516826964 | 0.6499 |
| hCV29945430 | rs7517436 | hCV32055284 | rs12079653 | 0.51 | 0.516826964 | 0.6676 |
| hCV29945430 | rs7517436 | hCV32055470 | rs6577506 | 0.51 | 0.516826964 | 0.7188 |
| hCV29945430 | rs7517436 | hCV32055474 | rs10864359 | 0.51 | 0.516826964 | 0.6717 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV29945430 | rs7517436 | hCV32055477 | rs10779705 | 0.51 | 0.516826964 | 0.7979 |
| hCV29945430 | rs7517436 | hCV32055527 | rs10864364 | 0.51 | 0.516826964 | 1 |
| hCV29945430 | rs7517436 | hCV32055548 | rs11121197 | 0.51 | 0.516826964 | 0.6952 |
| hCV29945430 | rs7517436 | hCV32055579 | rs6577522 | 0.51 | 0.516826964 | 1 |
| hCV29945430 | rs7517436 | hCV32055595 | rs6577524 | 0.51 | 0.516826964 | 1 |
| hCV29945430 | rs7517436 | hCV32055596 | rs6577525 | 0.51 | 0.516826964 | 1 |
| hCV29945430 | rs7517436 | hCV32055625 | rs6678590 | 0.51 | 0.516826964 | 0.8645 |
| hCV29945430 | rs7517436 | hCV32055637 | rs6577532 | 0.51 | 0.516826964 | 0.8301 |
| hCV29945430 | rs7517436 | hCV32055662 | rs6677249 | 0.51 | 0.516826964 | 0.645 |
| hCV29945430 | rs7517436 | hCV32055677 | rs10864355 | 0.51 | 0.516826964 | 0.6952 |
| hCV29945430 | rs7517436 | hCV529178 | rs301811 | 0.51 | 0.516826964 | 0.6949 |
| hCV29945430 | rs7517436 | hCV529182 | rs301800 | 0.51 | 0.516826964 | 0.6998 |
| hCV29945430 | rs7517436 | hCV597227 | rs301809 | 0.51 | 0.516826964 | 0.6952 |
| hCV29945430 | rs7517436 | hCV597229 | rs301785 | 0.51 | 0.516826964 | 0.6952 |
| hCV29945430 | rs7517436 | hCV877241 | rs301788 | 0.51 | 0.516826964 | 0.6713 |
| hCV29945430 | rs7517436 | hCV8823713 | rs1472228 | 0.51 | 0.516826964 | 1 |
| hCV29945430 | rs7517436 | hCV8824244 | rs1006950 | 0.51 | 0.516826964 | 0.574 |
| hCV29945430 | rs7517436 | hCV8824248 | rs1543711 | 0.51 | 0.516826964 | 0.6126 |
| hCV29945430 | rs7517436 | hCV8824288 | rs910582 | 0.51 | 0.516826964 | 0.6952 |
| hCV29945430 | rs7517436 | hCV8824394 | rs1443929 | 0.51 | 0.516826964 | 0.6713 |
| hCV29945430 | rs7517436 | hCV8824424 | rs1058790 | 0.51 | 0.516826964 | 0.6727 |
| hCV29945430 | rs7517436 | hCV8824425 | rs1058791 | 0.51 | 0.516826964 | 0.6383 |
| hCV29945430 | rs7517436 | hCV8881145 | rs1038008 | 0.51 | 0.516826964 | 0.7979 |
| hCV29945430 | rs7517436 | hCV8881146 | rs1463054 | 0.51 | 0.516826964 | 0.8032 |
| hCV29945430 | rs7517436 | hCV8881157 | rs1535158 | 0.51 | 0.516826964 | 0.7979 |
| hCV29945430 | rs7517436 | hCV8881161 | rs926951 | 0.51 | 0.516826964 | 0.6717 |
| hCV29952522 | rs9457931 | hCV16072675 | rs2130087 | 0.51 | 0.408966509 | 0.7435 |
| hCV29952522 | rs9457931 | hCV27502709 | rs3798158 | 0.51 | 0.408966509 | 0.7431 |
| hCV29952522 | rs9457931 | hCV29109993 | rs7757997 | 0.51 | 0.408966509 | 1 |
| hCV29952522 | rs9457931 | hCV29109993 | rs7757997 | 0.51 | 0.838470755 | 1 |
| hCV29952522 | rs9457931 | hCV29683578 | rs7761031 | 0.51 | 0.408966509 | 1 |
| hCV29952522 | rs9457931 | hCV29683578 | rs7761031 | 0.51 | 0.838470755 | 1 |
| hCV29952522 | rs9457931 | hCV29774032 | rs9457881 | 0.51 | 0.408966509 | 1 |
| hCV29952522 | rs9457931 | hCV29774032 | rs9457881 | 0.51 | 0.838470755 | 1 |
| hCV29952522 | rs9457931 | hCV29809835 | rs9457880 | 0.51 | 0.408966509 | 0.7436 |
| hCV29952522 | rs9457931 | hCV30296556 | rs10499313 | 0.51 | 0.408966509 | 0.7436 |
| hCV29952522 | rs9457931 | hCV30350563 | rs9457882 | 0.51 | 0.408966509 | 0.7436 |
| hCV30136303 | rs6914527 | hCV11542275 | rs3105258 | 0.51 | 0.9 | 0.9295 |
| hCV30136303 | rs6914527 | hCV11542286 | rs3125275 | 0.51 | 0.9 | 1 |
| hCV30136303 | rs6914527 | hCV11559368 | rs6899649 | 0.51 | 0.9 | 0.9428 |
| hCV30136303 | rs6914527 | hCV11560148 | rs11966562 | 0.51 | 0.9 | 0.9048 |
| hCV30136303 | rs6914527 | hCV12026670 | rs2047809 | 0.51 | 0.9 | 0.9244 |
| hCV30136303 | rs6914527 | hCV238179 | rs9370364 | 0.51 | 0.9 | 1 |
| hCV30136303 | rs6914527 | hCV238181 | rs11968305 | 0.51 | 0.9 | 0.9244 |
| hCV30136303 | rs6914527 | hCV238185 | rs6914267 | 0.51 | 0.9 | 1 |
| hCV30136303 | rs6914527 | hCV26549031 | rs6907460 | 0.51 | 0.9 | 0.9616 |
| hCV30136303 | rs6914527 | hCV26549047 | rs4518493 | 0.51 | 0.9 | 0.9226 |
| hCV30136303 | rs6914527 | hCV26549113 | rs4236122 | 0.51 | 0.9 | 0.9161 |
| hCV30136303 | rs6914527 | hCV27953375 | rs4712088 | 0.51 | 0.9 | 0.9048 |
| hCV30136303 | rs6914527 | hCV27975017 | rs4398735 | 0.51 | 0.9 | 0.9244 |
| hCV30136303 | rs6914527 | hCV29161721 | rs6915903 | 0.51 | 0.9 | 0.9309 |
| hCV30136303 | rs6914527 | hCV29161723 | rs7766969 | 0.51 | 0.9 | 0.9244 |
| hCV30136303 | rs6914527 | hCV30225897 | rs9357829 | 0.51 | 0.9 | 0.9309 |
| hCV30136303 | rs6914527 | hCV358624 | rs4715508 | 0.51 | 0.9 | 0.9036 |
| hCV30136303 | rs6914527 | hCV461035 | rs7746448 | 0.51 | 0.9 | 0.9415 |
| hCV30233466 | rs7513880 | hCV1188706 | rs2185205 | 0.51 | 0.771664644 | 0.8883 |
| hCV30233466 | rs7513880 | hCV1188726 | rs6698830 | 0.51 | 0.771664644 | 1 |
| hCV30233466 | rs7513880 | hCV1188747 | rs4908511 | 0.51 | 0.771664644 | 0.8871 |
| hCV30233466 | rs7513880 | hCV1188748 | rs12028160 | 0.51 | 0.771664644 | 0.9066 |
| hCV30233466 | rs7513880 | hCV29855298 | rs6690928 | 0.51 | 0.771664644 | 1 |
| hCV30233466 | rs7513880 | hCV29981708 | rs7554486 | 0.51 | 0.771664644 | 0.7756 |
| hCV30233466 | rs7513880 | hCV32055554 | rs12024032 | 0.51 | 0.771664644 | 0.9066 |
| hCV30233466 | rs7513880 | hCV32055587 | rs10864367 | 0.51 | 0.771664644 | 1 |
| hCV30233466 | rs7513880 | hCV32055630 | rs4908518 | 0.51 | 0.771664644 | 0.8883 |
| hCV30233466 | rs7513880 | hDV75072264 | rs12403640 | 0.51 | 0.771664644 | 0.8888 |
| hCV3026189 | rs11739136 | hCV15861099 | rs2071161 | 0.51 | 0.9 | 1 |
| hCV30264691 | rs10508518 | hCV29218874 | rs7087976 | 0.51 | 0.9 | 1 |
| hCV30264691 | rs10508518 | hCV29218875 | rs7087834 | 0.51 | 0.9 | 1 |
| hCV30264691 | rs10508518 | hCV3134992 | rs4748342 | 0.51 | 0.9 | 1 |
| hCV30264691 | rs10508518 | hCV3135019 | rs7897550 | 0.51 | 0.9 | 0.9123 |
| hCV30264691 | rs10508518 | hDV72006105 | rs7916443 | 0.51 | 0.9 | 1 |
| hCV30287627 | rs6675443 | hCV11398047 | rs1922983 | 0.51 | 0.758102092 | 0.9094 |
| hCV30287627 | rs6675443 | hCV11398445 | rs1934138 | 0.51 | 0.758102092 | 1 |
| hCV30287627 | rs6675443 | hCV11675339 | rs7530745 | 0.51 | 0.758102092 | 0.9135 |
| hCV30287627 | rs6675443 | hCV11675982 | rs1953827 | 0.51 | 0.758102092 | 0.9521 |
| hCV30287627 | rs6675443 | hCV11675985 | rs12136766 | 0.51 | 0.758102092 | 0.9521 |
| hCV30287627 | rs6675443 | hCV1265820 | rs6577488 | 0.51 | 0.758102092 | 0.9094 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV30287627 | rs6675443 | hCV1265823 | rs1024197 | 0.51 | 0.758102092 | 0.9135 |
| hCV30287627 | rs6675443 | hCV1265830 | rs7551849 | 0.51 | 0.758102092 | 0.9135 |
| hCV30287627 | rs6675443 | hCV1265841 | rs10864354 | 0.51 | 0.758102092 | 0.8743 |
| hCV30287627 | rs6675443 | hCV1265857 | rs10864356 | 0.51 | 0.758102092 | 0.9135 |
| hCV30287627 | rs6675443 | hCV1265858 | rs11121194 | 0.51 | 0.758102092 | 0.9511 |
| hCV30287627 | rs6675443 | hCV1265860 | rs6577491 | 0.51 | 0.758102092 | 0.9094 |
| hCV30287627 | rs6675443 | hCV1265866 | rs6577496 | 0.51 | 0.758102092 | 0.9069 |
| hCV30287627 | rs6675443 | hCV16007535 | rs2401138 | 0.51 | 0.758102092 | 0.9093 |
| hCV30287627 | rs6675443 | hCV27157433 | rs7544052 | 0.51 | 0.758102092 | 0.866 |
| hCV30287627 | rs6675443 | hCV27157435 | rs7513420 | 0.51 | 0.758102092 | 0.8672 |
| hCV30287627 | rs6675443 | hCV27157439 | rs10779704 | 0.51 | 0.758102092 | 0.894 |
| hCV30287627 | rs6675443 | hCV27157529 | rs1463049 | 0.51 | 0.758102092 | 0.9062 |
| hCV30287627 | rs6675443 | hCV27157851 | rs4480384 | 0.51 | 0.758102092 | 1 |
| hCV30287627 | rs6675443 | hCV27979869 | rs4908760 | 0.51 | 0.758102092 | 0.8685 |
| hCV30287627 | rs6675443 | hCV29368911 | rs6577513 | 0.51 | 0.758102092 | 0.9041 |
| hCV30287627 | rs6675443 | hCV29368927 | rs6577499 | 0.51 | 0.758102092 | 0.9094 |
| hCV30287627 | rs6675443 | hCV29368929 | rs6577502 | 0.51 | 0.758102092 | 0.9135 |
| hCV30287627 | rs6675443 | hCV29674579 | rs7542312 | 0.51 | 0.758102092 | 0.9135 |
| hCV30287627 | rs6675443 | hCV30341660 | rs6681362 | 0.51 | 0.758102092 | 1 |
| hCV30287627 | rs6675443 | hCV30413939 | rs6701331 | 0.51 | 0.758102092 | 0.9521 |
| hCV30287627 | rs6675443 | hCV30413946 | rs7537982 | 0.51 | 0.758102092 | 1 |
| hCV30287627 | rs6675443 | hCV3086941 | rs7556169 | 0.51 | 0.758102092 | 0.9047 |
| hCV30287627 | rs6675443 | hCV3086945 | rs6695867 | 0.51 | 0.758102092 | 0.9531 |
| hCV30287627 | rs6675443 | hCV3086948 | rs10864361 | 0.51 | 0.758102092 | 0.8606 |
| hCV30287627 | rs6675443 | hCV3086949 | rs11121212 | 0.51 | 0.758102092 | 0.9135 |
| hCV30287627 | rs6675443 | hCV3086952 | rs6577514 | 0.51 | 0.758102092 | 0.9061 |
| hCV30287627 | rs6675443 | hCV3086954 | rs1463053 | 0.51 | 0.758102092 | 0.9047 |
| hCV30287627 | rs6675443 | hCV3086956 | rs1463052 | 0.51 | 0.758102092 | 0.9521 |
| hCV30287627 | rs6675443 | hCV3086959 | rs7520025 | 0.51 | 0.758102092 | 0.9547 |
| hCV30287627 | rs6675443 | hCV3086965 | rs1381928 | 0.51 | 0.758102092 | 1 |
| hCV30287627 | rs6675443 | hCV3086974 | rs1318218 | 0.51 | 0.758102092 | 1 |
| hCV30287627 | rs6675443 | hCV3086976 | rs11121204 | 0.51 | 0.758102092 | 1 |
| hCV30287627 | rs6675443 | hCV3086978 | rs7526171 | 0.51 | 0.758102092 | 1 |
| hCV30287627 | rs6675443 | hCV3086981 | rs6670508 | 0.51 | 0.758102092 | 1 |
| hCV30287627 | rs6675443 | hCV3086985 | rs6663123 | 0.51 | 0.758102092 | 1 |
| hCV30287627 | rs6675443 | hCV3086990 | rs11121202 | 0.51 | 0.758102092 | 1 |
| hCV30287627 | rs6675443 | hCV3087002 | rs1473420 | 0.51 | 0.758102092 | 0.9094 |
| hCV30287627 | rs6675443 | hCV3087004 | rs2016084 | 0.51 | 0.758102092 | 0.8312 |
| hCV30287627 | rs6675443 | hCV3087005 | rs6702060 | 0.51 | 0.758102092 | 0.9129 |
| hCV30287627 | rs6675443 | hCV3087012 | rs1463051 | 0.51 | 0.758102092 | 0.9094 |
| hCV30287627 | rs6675443 | hCV32055336 | rs12080583 | 0.51 | 0.758102092 | 0.9111 |
| hCV30287627 | rs6675443 | hCV32055351 | rs12046643 | 0.51 | 0.758102092 | 0.9111 |
| hCV30287627 | rs6675443 | hCV32055354 | rs4908761 | 0.51 | 0.758102092 | 0.9069 |
| hCV30287627 | rs6675443 | hCV32055465 | rs6668508 | 0.51 | 0.758102092 | 0.9094 |
| hCV30287627 | rs6675443 | hCV32055479 | rs11121210 | 0.51 | 0.758102092 | 0.9543 |
| hCV30287627 | rs6675443 | hCV32055489 | rs10864360 | 0.51 | 0.758102092 | 0.9135 |
| hCV30287627 | rs6675443 | hCV32055490 | rs6669503 | 0.51 | 0.758102092 | 0.9135 |
| hCV30287627 | rs6675443 | hCV32055496 | rs11121215 | 0.51 | 0.758102092 | 0.9093 |
| hCV30287627 | rs6675443 | hCV32055498 | rs4908507 | 0.51 | 0.758102092 | 0.9531 |
| hCV30287627 | rs6675443 | hCV32055588 | rs12131864 | 0.51 | 0.758102092 | 0.9135 |
| hCV30287627 | rs6675443 | hCV32056071 | rs11121201 | 0.51 | 0.758102092 | 0.9135 |
| hCV30287627 | rs6675443 | hCV32392515 | rs4908505 | 0.51 | 0.758102092 | 0.8606 |
| hCV30287627 | rs6675443 | hCV597221 | rs301814 | 0.51 | 0.758102092 | 0.9135 |
| hCV30287627 | rs6675443 | hCV8881153 | rs1061039 | 0.51 | 0.758102092 | 1 |
| hCV30287627 | rs6675443 | hDV77058075 | rs4908506 | 0.51 | 0.758102092 | 0.9047 |
| hCV30454150 | rs10516434 | hCV28960525 | rs6532740 | 0.51 | 0.9 | 0.9227 |
| hCV30454150 | rs10516434 | hCV28960526 | rs6853079 | 0.51 | 0.9 | 0.9309 |
| hCV30454150 | rs10516434 | hCV29480044 | rs10516433 | 0.51 | 0.9 | 0.9309 |
| hCV30454150 | rs10516434 | hCV30694936 | rs6840610 | 0.51 | 0.9 | 0.9309 |
| hCV30454150 | rs10516434 | hDV70961198 | rs17498778 | 0.51 | 0.9 | 0.9309 |
| hCV30454150 | rs10516434 | hDV70969482 | rs17564872 | 0.51 | 0.9 | 0.9309 |
| hCV30454150 | rs10516434 | hDV71951446 | rs7689289 | 0.51 | 0.9 | 0.9309 |
| hCV30467730 | rs6702457 | hCV11398434 | rs1812457 | 0.51 | 0.534550731 | 0.9381 |
| hCV30467730 | rs6702457 | hCV11398437 | rs1817367 | 0.51 | 0.534550731 | 0.9276 |
| hCV30467730 | rs6702457 | hCV11675962 | rs10746481 | 0.51 | 0.534550731 | 1 |
| hCV30467730 | rs6702457 | hCV1188664 | rs2765511 | 0.51 | 0.534550731 | 0.54 |
| hCV30467730 | rs6702457 | hCV1188665 | rs2781060 | 0.51 | 0.534550731 | 0.556 |
| hCV30467730 | rs6702457 | hCV1188731 | rs4908514 | 0.51 | 0.534550731 | 0.8774 |
| hCV30467730 | rs6702457 | hCV1188735 | rs10864366 | 0.51 | 0.534550731 | 0.8704 |
| hCV30467730 | rs6702457 | hCV12040675 | rs2038904 | 0.51 | 0.534550731 | 0.54 |
| hCV30467730 | rs6702457 | hCV15882429 | rs2289732 | 0.51 | 0.534550731 | 0.5549 |
| hCV30467730 | rs6702457 | hCV15932991 | rs2781067 | 0.51 | 0.534550731 | 0.5861 |
| hCV30467730 | rs6702457 | hCV15932992 | rs2781068 | 0.51 | 0.534550731 | 0.5389 |
| hCV30467730 | rs6702457 | hCV27157507 | rs6664000 | 0.51 | 0.534550731 | 0.8704 |
| hCV30467730 | rs6702457 | hCV27157524 | rs6577531 | 0.51 | 0.534550731 | 0.8175 |
| hCV30467730 | rs6702457 | hCV27884601 | rs4908776 | 0.51 | 0.534550731 | 0.877 |
| hCV30467730 | rs6702457 | hCV27958354 | rs4908762 | 0.51 | 0.534550731 | 0.815 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV30467730 | rs6702457 | hCV28023091 | rs4908773 | 0.51 | 0.534550731 | 0.8704 |
| hCV30467730 | rs6702457 | hCV29368919 | rs4908513 | 0.51 | 0.534550731 | 0.8774 |
| hCV30467730 | rs6702457 | hCV2943451 | rs902355 | 0.51 | 0.534550731 | 0.6259 |
| hCV30467730 | rs6702457 | hCV2943853 | rs301793 | 0.51 | 0.534550731 | 0.5549 |
| hCV30467730 | rs6702457 | hCV2966436 | rs11121174 | 0.51 | 0.534550731 | 0.5549 |
| hCV30467730 | rs6702457 | hCV2966437 | rs11580417 | 0.51 | 0.534550731 | 0.5549 |
| hCV30467730 | rs6702457 | hCV2966441 | rs6684863 | 0.51 | 0.534550731 | 0.5549 |
| hCV30467730 | rs6702457 | hCV2966444 | rs11121171 | 0.51 | 0.534550731 | 0.5975 |
| hCV30467730 | rs6702457 | hCV29819064 | rs6698079 | 0.51 | 0.534550731 | 0.919 |
| hCV30467730 | rs6702457 | hCV2987250 | rs301810 | 0.51 | 0.534550731 | 0.633 |
| hCV30467730 | rs6702457 | hCV29873524 | rs7533113 | 0.51 | 0.534550731 | 0.8774 |
| hCV30467730 | rs6702457 | hCV29873526 | rs6697997 | 0.51 | 0.534550731 | 0.8248 |
| hCV30467730 | rs6702457 | hCV29945430 | rs7517436 | 0.51 | 0.534550731 | 0.8704 |
| hCV30467730 | rs6702457 | hCV30035535 | rs7518204 | 0.51 | 0.534550731 | 0.877 |
| hCV30467730 | rs6702457 | hCV30125699 | rs4581300 | 0.51 | 0.534550731 | 0.815 |
| hCV30467730 | rs6702457 | hCV30143725 | rs6690050 | 0.51 | 0.534550731 | 0.8785 |
| hCV30467730 | rs6702457 | hCV3086930 | rs6658881 | 0.51 | 0.534550731 | 1 |
| hCV30467730 | rs6702457 | hCV3086932 | rs7533442 | 0.51 | 0.534550731 | 1 |
| hCV30467730 | rs6702457 | hCV3086950 | rs4908771 | 0.51 | 0.534550731 | 1 |
| hCV30467730 | rs6702457 | hCV3086961 | rs6703577 | 0.51 | 0.534550731 | 0.9345 |
| hCV30467730 | rs6702457 | hCV3086971 | rs6679948 | 0.51 | 0.534550731 | 0.9381 |
| hCV30467730 | rs6702457 | hCV3086972 | rs6688329 | 0.51 | 0.534550731 | 0.9345 |
| hCV30467730 | rs6702457 | hCV3086998 | rs7530863 | 0.51 | 0.534550731 | 0.815 |
| hCV30467730 | rs6702457 | hCV3087000 | rs1463055 | 0.51 | 0.534550731 | 0.8248 |
| hCV30467730 | rs6702457 | hCV3087003 | rs6577500 | 0.51 | 0.534550731 | 0.8248 |
| hCV30467730 | rs6702457 | hCV3087015 | rs11121198 | 0.51 | 0.534550731 | 0.8248 |
| hCV30467730 | rs6702457 | hCV3087016 | rs2297867 | 0.51 | 0.534550731 | 0.815 |
| hCV30467730 | rs6702457 | hCV32055284 | rs12079653 | 0.51 | 0.534550731 | 0.6352 |
| hCV30467730 | rs6702457 | hCV32055470 | rs6577506 | 0.51 | 0.534550731 | 0.9345 |
| hCV30467730 | rs6702457 | hCV32055474 | rs10864359 | 0.51 | 0.534550731 | 0.9345 |
| hCV30467730 | rs6702457 | hCV32055477 | rs10779705 | 0.51 | 0.534550731 | 0.9381 |
| hCV30467730 | rs6702457 | hCV32055527 | rs10864364 | 0.51 | 0.534550731 | 0.8704 |
| hCV30467730 | rs6702457 | hCV32055548 | rs11121197 | 0.51 | 0.534550731 | 0.8248 |
| hCV30467730 | rs6702457 | hCV32055579 | rs6577522 | 0.51 | 0.534550731 | 0.8774 |
| hCV30467730 | rs6702457 | hCV32055595 | rs6577524 | 0.51 | 0.534550731 | 0.8774 |
| hCV30467730 | rs6702457 | hCV32055596 | rs6577525 | 0.51 | 0.534550731 | 0.8704 |
| hCV30467730 | rs6702457 | hCV32055625 | rs6678590 | 0.51 | 0.534550731 | 0.7684 |
| hCV30467730 | rs6702457 | hCV32055637 | rs6577532 | 0.51 | 0.534550731 | 0.8069 |
| hCV30467730 | rs6702457 | hCV32055662 | rs6677249 | 0.51 | 0.534550731 | 0.6372 |
| hCV30467730 | rs6702457 | hCV32055677 | rs10864355 | 0.51 | 0.534550731 | 0.8248 |
| hCV30467730 | rs6702457 | hCV529178 | rs301811 | 0.51 | 0.534550731 | 0.8246 |
| hCV30467730 | rs6702457 | hCV529182 | rs301800 | 0.51 | 0.534550731 | 0.5758 |
| hCV30467730 | rs6702457 | hCV597227 | rs301809 | 0.51 | 0.534550731 | 0.8248 |
| hCV30467730 | rs6702457 | hCV597229 | rs301785 | 0.51 | 0.534550731 | 0.8248 |
| hCV30467730 | rs6702457 | hCV8823713 | rs1472228 | 0.51 | 0.534550731 | 0.8704 |
| hCV30467730 | rs6702457 | hCV8824248 | rs1543711 | 0.51 | 0.534550731 | 0.54 |
| hCV30467730 | rs6702457 | hCV8824288 | rs910582 | 0.51 | 0.534550731 | 0.8248 |
| hCV30467730 | rs6702457 | hCV8824424 | rs1058790 | 0.51 | 0.534550731 | 0.5975 |
| hCV30467730 | rs6702457 | hCV8824425 | rs1058791 | 0.51 | 0.534550731 | 0.5737 |
| hCV30467730 | rs6702457 | hCV8881145 | rs1038008 | 0.51 | 0.534550731 | 0.9381 |
| hCV30467730 | rs6702457 | hCV8881146 | rs1463054 | 0.51 | 0.534550731 | 0.9064 |
| hCV30467730 | rs6702457 | hCV8881157 | rs1535158 | 0.51 | 0.534550731 | 0.9381 |
| hCV30467730 | rs6702457 | hCV8881161 | rs926951 | 0.51 | 0.534550731 | 0.815 |
| hCV30534667 | rs4996259 | hCV26718978 | rs7779312 | 0.51 | 0.9 | 0.9383 |
| hCV30534667 | rs4996259 | hCV2677705 | rs12670134 | 0.51 | 0.9 | 0.9021 |
| hCV30534667 | rs4996259 | hCV2677722 | rs1548868 | 0.51 | 0.9 | 1 |
| hCV30534667 | rs4996259 | hCV2677723 | rs3735442 | 0.51 | 0.9 | 1 |
| hCV30534667 | rs4996259 | hCV29210278 | rs7784056 | 0.51 | 0.9 | 1 |
| hCV30586985 | rs10126006 | hCV11373123 | rs1984003 | 0.51 | 0.485664418 | 0.6184 |
| hCV30586985 | rs10126006 | hCV11765727 | rs10781379 | 0.51 | 0.485664418 | 0.6121 |
| hCV30586985 | rs10126006 | hCV11765729 | rs7875659 | 0.51 | 0.485664418 | 0.6108 |
| hCV30586985 | rs10126006 | hCV11765753 | rs3793456 | 0.51 | 0.485664418 | 0.8904 |
| hCV30586985 | rs10126006 | hCV1463101 | rs7871596 | 0.51 | 0.485664418 | 0.6831 |
| hCV30586985 | rs10126006 | hCV1463112 | rs3763608 | 0.51 | 0.485664418 | 0.8497 |
| hCV30586985 | rs10126006 | hCV1463185 | rs953588 | 0.51 | 0.485664418 | 0.5648 |
| hCV30586985 | rs10126006 | hCV1463216 | rs4745581 | 0.51 | 0.485664418 | 0.6289 |
| hCV30586985 | rs10126006 | hCV1463218 | rs1984004 | 0.51 | 0.485664418 | 0.6 |
| hCV30586985 | rs10126006 | hCV1463222 | rs4744808 | 0.51 | 0.485664418 | 0.6289 |
| hCV30586985 | rs10126006 | hCV1463225 | rs4745577 | 0.51 | 0.485664418 | 0.6184 |
| hCV30586985 | rs10126006 | hCV1463226 | rs10890 | 0.51 | 0.485664418 | 0.6289 |
| hCV30586985 | rs10126006 | hCV1463232 | rs9314854 | 0.51 | 0.485664418 | 0.6289 |
| hCV30586985 | rs10126006 | hCV1463235 | rs2498430 | 0.51 | 0.485664418 | 0.6815 |
| hCV30586985 | rs10126006 | hCV1463244 | rs3793465 | 0.51 | 0.485664418 | 0.9422 |
| hCV30586985 | rs10126006 | hCV1463247 | rs3829064 | 0.51 | 0.485664418 | 0.6431 |
| hCV30586985 | rs10126006 | hCV1463251 | rs2498434 | 0.51 | 0.485664418 | 0.7097 |
| hCV30586985 | rs10126006 | hCV1463252 | rs3793461 | 0.51 | 0.485664418 | 0.9284 |
| hCV30586985 | rs10126006 | hCV1463256 | rs2309394 | 0.51 | 0.485664418 | 0.7296 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV30586985 | rs10126006 | hCV15761059 | rs2309393 | 0.51 | 0.485664418 | 0.9422 |
| hCV30586985 | rs10126006 | hCV15892414 | rs2498431 | 0.51 | 0.485664418 | 0.6815 |
| hCV30586985 | rs10126006 | hCV15892430 | rs2498433 | 0.51 | 0.485664418 | 0.5477 |
| hCV30586985 | rs10126006 | hCV25609765 | rs3829062 | 0.51 | 0.485664418 | 0.7296 |
| hCV30586985 | rs10126006 | hCV26566199 | rs3793467 | 0.51 | 0.485664418 | 0.9284 |
| hCV30586985 | rs10126006 | hCV26566299 | rs10869821 | 0.51 | 0.485664418 | 0.6497 |
| hCV30586985 | rs10126006 | hCV27517372 | rs3793457 | 0.51 | 0.485664418 | 0.67 |
| hCV30586985 | rs10126006 | hCV28008078 | rs4745543 | 0.51 | 0.485664418 | 0.8573 |
| hCV30586985 | rs10126006 | hCV29861776 | rs9411171 | 0.51 | 0.485664418 | 0.6431 |
| hCV30586985 | rs10126006 | hCV31363797 | rs11145043 | 0.51 | 0.485664418 | 0.9036 |
| hCV30586985 | rs10126006 | hCV31363840 | rs7875693 | 0.51 | 0.485664418 | 0.8834 |
| hCV30586985 | rs10126006 | hCV31363841 | rs7849347 | 0.51 | 0.485664418 | 0.8548 |
| hCV30586985 | rs10126006 | hCV31363869 | rs11145070 | 0.51 | 0.485664418 | 0.6279 |
| hCV30586985 | rs10126006 | hCV31363888 | rs7859021 | 0.51 | 0.485664418 | 0.6289 |
| hCV30586985 | rs10126006 | hCV31363984 | rs7855905 | 0.51 | 0.485664418 | 0.8671 |
| hCV30586985 | rs10126006 | hCV320569 | rs9411170 | 0.51 | 0.485664418 | 0.6762 |
| hCV30586985 | rs10126006 | hCV8785184 | rs1411676 | 0.51 | 0.485664418 | 0.6184 |
| hCV30586985 | rs10126006 | hCV8785185 | rs1411675 | 0.51 | 0.485664418 | 0.6289 |
| hCV30586985 | rs10126006 | hCV9333267 | rs1045632 | 0.51 | 0.485664418 | 0.6289 |
| hCV30586985 | rs10126006 | hCV71871695 | rs7047274 | 0.51 | 0.485664418 | 0.6902 |
| hCV30606396 | rs10438978 | hCV15846640 | rs2187375 | 0.51 | 0.9 | 0.9391 |
| hCV30606396 | rs10438978 | hCV16140621 | rs2156552 | 0.51 | 0.9 | 0.9392 |
| hCV30606396 | rs10438978 | hCV27889421 | rs4939883 | 0.51 | 0.9 | 1 |
| hCV30606396 | rs10438978 | hCV29202191 | rs7240405 | 0.51 | 0.9 | 0.9694 |
| hCV30606396 | rs10438978 | hCV29202193 | rs7239867 | 0.51 | 0.9 | 0.9694 |
| hCV30606396 | rs10438978 | hCV29202195 | rs8086351 | 0.51 | 0.9 | 0.9438 |
| hCV30606396 | rs10438978 | hCV30011938 | rs7241918 | 0.51 | 0.9 | 1 |
| hCV30606396 | rs10438978 | hCV71197604 | rs1943981 | 0.51 | 0.9 | 0.9459 |
| hCV30764105 | rs12521915 | hCV15758655 | rs2303122 | 0.51 | 0.9 | 1 |
| hCV30764105 | rs12521915 | hCV2929716 | rs7725246 | 0.51 | 0.9 | 0.9371 |
| hCV3086932 | rs7533442 | hCV11398434 | rs1812457 | 0.51 | 0.411159327 | 0.9345 |
| hCV3086932 | rs7533442 | hCV11398437 | rs1817367 | 0.51 | 0.411159327 | 0.8687 |
| hCV3086932 | rs7533442 | hCV11675962 | rs10746481 | 0.51 | 0.411159327 | 1 |
| hCV3086932 | rs7533442 | hCV1188659 | rs3820037 | 0.51 | 0.411159327 | 0.4725 |
| hCV3086932 | rs7533442 | hCV1188660 | rs6660137 | 0.51 | 0.411159327 | 0.4816 |
| hCV3086932 | rs7533442 | hCV1188664 | rs2765511 | 0.51 | 0.411159327 | 0.5167 |
| hCV3086932 | rs7533442 | hCV1188665 | rs2781060 | 0.51 | 0.411159327 | 0.5328 |
| hCV3086932 | rs7533442 | hCV1188676 | rs11121247 | 0.51 | 0.411159327 | 0.4816 |
| hCV3086932 | rs7533442 | hCV1188731 | rs4908514 | 0.51 | 0.411159327 | 0.8704 |
| hCV3086932 | rs7533442 | hCV1188735 | rs10864366 | 0.51 | 0.411159327 | 0.8213 |
| hCV3086932 | rs7533442 | hCV12040675 | rs2038904 | 0.51 | 0.411159327 | 0.5167 |
| hCV3086932 | rs7533442 | hCV15882429 | rs2289732 | 0.51 | 0.411159327 | 0.5302 |
| hCV3086932 | rs7533442 | hCV15932991 | rs2781067 | 0.51 | 0.411159327 | 0.5621 |
| hCV3086932 | rs7533442 | hCV15932992 | rs2781068 | 0.51 | 0.411159327 | 0.5153 |
| hCV3086932 | rs7533442 | hCV27157507 | rs6664000 | 0.51 | 0.411159327 | 0.8213 |
| hCV3086932 | rs7533442 | hCV27157524 | rs6577531 | 0.51 | 0.411159327 | 0.8069 |
| hCV3086932 | rs7533442 | hCV2741759 | rs11121179 | 0.51 | 0.411159327 | 0.5418 |
| hCV3086932 | rs7533442 | hCV27474399 | rs3753275 | 0.51 | 0.411159327 | 0.4658 |
| hCV3086932 | rs7533442 | hCV27884601 | rs4908776 | 0.51 | 0.411159327 | 0.87 |
| hCV3086932 | rs7533442 | hCV27958354 | rs4908762 | 0.51 | 0.411159327 | 0.8501 |
| hCV3086932 | rs7533442 | hCV28023091 | rs4908773 | 0.51 | 0.411159327 | 0.8213 |
| hCV3086932 | rs7533442 | hCV29368919 | rs4908513 | 0.51 | 0.411159327 | 0.8704 |
| hCV3086932 | rs7533442 | hCV2943451 | rs902355 | 0.51 | 0.411159327 | 0.6039 |
| hCV3086932 | rs7533442 | hCV2943853 | rs301793 | 0.51 | 0.411159327 | 0.5302 |
| hCV3086932 | rs7533442 | hCV2966436 | rs11121174 | 0.51 | 0.411159327 | 0.5302 |
| hCV3086932 | rs7533442 | hCV2966437 | rs11580417 | 0.51 | 0.411159327 | 0.5302 |
| hCV3086932 | rs7533442 | hCV2966441 | rs6684863 | 0.51 | 0.411159327 | 0.5302 |
| hCV3086932 | rs7533442 | hCV2966444 | rs11121171 | 0.51 | 0.411159327 | 0.5747 |
| hCV3086932 | rs7533442 | hCV29819064 | rs6698079 | 0.51 | 0.411159327 | 0.9184 |
| hCV3086932 | rs7533442 | hCV2987250 | rs301810 | 0.51 | 0.411159327 | 0.7185 |
| hCV3086932 | rs7533442 | hCV29873524 | rs7533113 | 0.51 | 0.411159327 | 0.8704 |
| hCV3086932 | rs7533442 | hCV29873526 | rs6697997 | 0.51 | 0.411159327 | 0.815 |
| hCV3086932 | rs7533442 | hCV29945430 | rs7517436 | 0.51 | 0.411159327 | 0.8213 |
| hCV3086932 | rs7533442 | hCV30035535 | rs7518204 | 0.51 | 0.411159327 | 0.87 |
| hCV3086932 | rs7533442 | hCV30125699 | rs4581300 | 0.51 | 0.411159327 | 0.7911 |
| hCV3086932 | rs7533442 | hCV30143725 | rs6690050 | 0.51 | 0.411159327 | 0.8714 |
| hCV3086932 | rs7533442 | hCV30287627 | rs6675443 | 0.51 | 0.411159327 | 0.4429 |
| hCV3086932 | rs7533442 | hCV30341660 | rs6681362 | 0.51 | 0.411159327 | 0.4193 |
| hCV3086932 | rs7533442 | hCV30467730 | rs6702457 | 0.51 | 0.411159327 | 1 |
| hCV3086932 | rs7533442 | hCV3086930 | rs6658881 | 0.51 | 0.411159327 | 1 |
| hCV3086932 | rs7533442 | hCV3086941 | rs7556169 | 0.51 | 0.411159327 | 0.4162 |
| hCV3086932 | rs7533442 | hCV3086950 | rs4908771 | 0.51 | 0.411159327 | 1 |
| hCV3086932 | rs7533442 | hCV3086952 | rs6577514 | 0.51 | 0.411159327 | 0.464 |
| hCV3086932 | rs7533442 | hCV3086961 | rs6703577 | 0.51 | 0.411159327 | 0.9091 |
| hCV3086932 | rs7533442 | hCV3086971 | rs6679948 | 0.51 | 0.411159327 | 0.9345 |
| hCV3086932 | rs7533442 | hCV3086972 | rs6688329 | 0.51 | 0.411159327 | 0.9305 |
| hCV3086932 | rs7533442 | hCV3086978 | rs7526171 | 0.51 | 0.411159327 | 0.439 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV3086932 | rs7533442 | hCV3086998 | rs7530863 | 0.51 | 0.411159327 | 0.8501 |
| hCV3086932 | rs7533442 | hCV3087000 | rs1463055 | 0.51 | 0.411159327 | 0.815 |
| hCV3086932 | rs7533442 | hCV3087003 | rs6577500 | 0.51 | 0.411159327 | 0.815 |
| hCV3086932 | rs7533442 | hCV3087015 | rs11121198 | 0.51 | 0.411159327 | 0.815 |
| hCV3086932 | rs7533442 | hCV3087016 | rs2297867 | 0.51 | 0.411159327 | 0.8228 |
| hCV3086932 | rs7533442 | hCV32055284 | rs12079653 | 0.51 | 0.411159327 | 0.6146 |
| hCV3086932 | rs7533442 | hCV32055470 | rs6577506 | 0.51 | 0.411159327 | 0.9091 |
| hCV3086932 | rs7533442 | hCV32055474 | rs10864359 | 0.51 | 0.411159327 | 0.85 |
| hCV3086932 | rs7533442 | hCV32055477 | rs10779705 | 0.51 | 0.411159327 | 0.9345 |
| hCV3086932 | rs7533442 | hCV32055496 | rs11121215 | 0.51 | 0.411159327 | 0.4393 |
| hCV3086932 | rs7533442 | hCV32055527 | rs10864364 | 0.51 | 0.411159327 | 0.8213 |
| hCV3086932 | rs7533442 | hCV32055548 | rs11121197 | 0.51 | 0.411159327 | 0.815 |
| hCV3086932 | rs7533442 | hCV32055579 | rs6577522 | 0.51 | 0.411159327 | 0.8704 |
| hCV3086932 | rs7533442 | hCV32055595 | rs6577524 | 0.51 | 0.411159327 | 0.8704 |
| hCV3086932 | rs7533442 | hCV32055596 | rs6577525 | 0.51 | 0.411159327 | 0.8213 |
| hCV3086932 | rs7533442 | hCV32055625 | rs6678590 | 0.51 | 0.411159327 | 0.7419 |
| hCV3086932 | rs7533442 | hCV32055637 | rs6577532 | 0.51 | 0.411159327 | 0.6768 |
| hCV3086932 | rs7533442 | hCV32055662 | rs6677249 | 0.51 | 0.411159327 | 0.5186 |
| hCV3086932 | rs7533442 | hCV32055677 | rs10864355 | 0.51 | 0.411159327 | 0.815 |
| hCV3086932 | rs7533442 | hCV529178 | rs301811 | 0.51 | 0.411159327 | 0.8149 |
| hCV3086932 | rs7533442 | hCV529182 | rs301800 | 0.51 | 0.411159327 | 0.5676 |
| hCV3086932 | rs7533442 | hCV597227 | rs301809 | 0.51 | 0.411159327 | 0.815 |
| hCV3086932 | rs7533442 | hCV597229 | rs301785 | 0.51 | 0.411159327 | 0.815 |
| hCV3086932 | rs7533442 | hCV877241 | rs301788 | 0.51 | 0.411159327 | 0.5418 |
| hCV3086932 | rs7533442 | hCV8823713 | rs1472228 | 0.51 | 0.411159327 | 0.8213 |
| hCV3086932 | rs7533442 | hCV8824244 | rs1006950 | 0.51 | 0.411159327 | 0.4725 |
| hCV3086932 | rs7533442 | hCV8824248 | rs1543711 | 0.51 | 0.411159327 | 0.5167 |
| hCV3086932 | rs7533442 | hCV8824288 | rs910582 | 0.51 | 0.411159327 | 0.815 |
| hCV3086932 | rs7533442 | hCV8824394 | rs1443929 | 0.51 | 0.411159327 | 0.5418 |
| hCV3086932 | rs7533442 | hCV8824424 | rs1058790 | 0.51 | 0.411159327 | 0.5747 |
| hCV3086932 | rs7533442 | hCV8824425 | rs1058791 | 0.51 | 0.411159327 | 0.5144 |
| hCV3086932 | rs7533442 | hCV8881145 | rs1038008 | 0.51 | 0.411159327 | 0.9345 |
| hCV3086932 | rs7533442 | hCV8881146 | rs1463054 | 0.51 | 0.411159327 | 0.9059 |
| hCV3086932 | rs7533442 | hCV8881157 | rs1535158 | 0.51 | 0.411159327 | 0.9345 |
| hCV3086932 | rs7533442 | hCV8881161 | rs926951 | 0.51 | 0.411159327 | 0.8501 |
| hCV3086932 | rs7533442 | hCV77058075 | rs4908506 | 0.51 | 0.411159327 | 0.4162 |
| hCV3086950 | rs4908771 | hCV11398434 | rs1812457 | 0.51 | 0.532308891 | 0.9381 |
| hCV3086950 | rs4908771 | hCV11398437 | rs1817367 | 0.51 | 0.532308891 | 0.9276 |
| hCV3086950 | rs4908771 | hCV11675962 | rs10746481 | 0.51 | 0.532308891 | 1 |
| hCV3086950 | rs4908771 | hCV1188664 | rs2765511 | 0.51 | 0.532308891 | 0.54 |
| hCV3086950 | rs4908771 | hCV1188665 | rs2781060 | 0.51 | 0.532308891 | 0.556 |
| hCV3086950 | rs4908771 | hCV1188731 | rs4908514 | 0.51 | 0.532308891 | 0.8774 |
| hCV3086950 | rs4908771 | hCV1188735 | rs10864366 | 0.51 | 0.532308891 | 0.8704 |
| hCV3086950 | rs4908771 | hCV12040675 | rs2038904 | 0.51 | 0.532308891 | 0.54 |
| hCV3086950 | rs4908771 | hCV15882429 | rs2289732 | 0.51 | 0.532308891 | 0.5549 |
| hCV3086950 | rs4908771 | hCV15932991 | rs2781067 | 0.51 | 0.532308891 | 0.5861 |
| hCV3086950 | rs4908771 | hCV15932992 | rs2781068 | 0.51 | 0.532308891 | 0.5389 |
| hCV3086950 | rs4908771 | hCV27157507 | rs6664000 | 0.51 | 0.532308891 | 0.8704 |
| hCV3086950 | rs4908771 | hCV27157524 | rs6577531 | 0.51 | 0.532308891 | 0.8175 |
| hCV3086950 | rs4908771 | hCV27884601 | rs4908776 | 0.51 | 0.532308891 | 0.877 |
| hCV3086950 | rs4908771 | hCV27958354 | rs4908762 | 0.51 | 0.532308891 | 0.815 |
| hCV3086950 | rs4908771 | hCV28023091 | rs4908773 | 0.51 | 0.532308891 | 0.8704 |
| hCV3086950 | rs4908771 | hCV29368919 | rs4908513 | 0.51 | 0.532308891 | 0.8774 |
| hCV3086950 | rs4908771 | hCV2943451 | rs902355 | 0.51 | 0.532308891 | 0.6259 |
| hCV3086950 | rs4908771 | hCV2943853 | rs301793 | 0.51 | 0.532308891 | 0.5549 |
| hCV3086950 | rs4908771 | hCV2966436 | rs11121174 | 0.51 | 0.532308891 | 0.5549 |
| hCV3086950 | rs4908771 | hCV2966437 | rs11580417 | 0.51 | 0.532308891 | 0.5549 |
| hCV3086950 | rs4908771 | hCV2966441 | rs6684863 | 0.51 | 0.532308891 | 0.5549 |
| hCV3086950 | rs4908771 | hCV2966444 | rs11121171 | 0.51 | 0.532308891 | 0.5975 |
| hCV3086950 | rs4908771 | hCV29819064 | rs6698079 | 0.51 | 0.532308891 | 0.919 |
| hCV3086950 | rs4908771 | hCV2987250 | rs301810 | 0.51 | 0.532308891 | 0.7323 |
| hCV3086950 | rs4908771 | hCV29873524 | rs7533113 | 0.51 | 0.532308891 | 0.8774 |
| hCV3086950 | rs4908771 | hCV29873526 | rs6697997 | 0.51 | 0.532308891 | 0.8248 |
| hCV3086950 | rs4908771 | hCV29945430 | rs7517436 | 0.51 | 0.532308891 | 0.8704 |
| hCV3086950 | rs4908771 | hCV30035535 | rs7518204 | 0.51 | 0.532308891 | 0.877 |
| hCV3086950 | rs4908771 | hCV30125699 | rs4581300 | 0.51 | 0.532308891 | 0.815 |
| hCV3086950 | rs4908771 | hCV30143725 | rs6690050 | 0.51 | 0.532308891 | 0.8785 |
| hCV3086950 | rs4908771 | hCV30467730 | rs6702457 | 0.51 | 0.532308891 | 1 |
| hCV3086950 | rs4908771 | hCV3086930 | rs6658881 | 0.51 | 0.532308891 | 1 |
| hCV3086950 | rs4908771 | hCV3086932 | rs7533442 | 0.51 | 0.532308891 | 1 |
| hCV3086950 | rs4908771 | hCV3086961 | rs6703577 | 0.51 | 0.532308891 | 0.9345 |
| hCV3086950 | rs4908771 | hCV3086971 | rs6679948 | 0.51 | 0.532308891 | 0.9381 |
| hCV3086950 | rs4908771 | hCV3086972 | rs6688329 | 0.51 | 0.532308891 | 0.9345 |
| hCV3086950 | rs4908771 | hCV3086998 | rs7530863 | 0.51 | 0.532308891 | 0.815 |
| hCV3086950 | rs4908771 | hCV3087000 | rs1463055 | 0.51 | 0.532308891 | 0.8248 |
| hCV3086950 | rs4908771 | hCV3087003 | rs6577500 | 0.51 | 0.532308891 | 0.8248 |
| hCV3086950 | rs4908771 | hCV3087015 | rs11121198 | 0.51 | 0.532308891 | 0.8248 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV3086950 | rs4908771 | hCV3087016 | rs2297867 | 0.51 | 0.532308891 | 0.815 |
| hCV3086950 | rs4908771 | hCV32055284 | rs12079653 | 0.51 | 0.532308891 | 0.6352 |
| hCV3086950 | rs4908771 | hCV32055470 | rs6577506 | 0.51 | 0.532308891 | 0.9345 |
| hCV3086950 | rs4908771 | hCV32055474 | rs10864359 | 0.51 | 0.532308891 | 0.9345 |
| hCV3086950 | rs4908771 | hCV32055477 | rs10779705 | 0.51 | 0.532308891 | 0.9381 |
| hCV3086950 | rs4908771 | hCV32055527 | rs10864364 | 0.51 | 0.532308891 | 0.8704 |
| hCV3086950 | rs4908771 | hCV32055548 | rs11121197 | 0.51 | 0.532308891 | 0.8248 |
| hCV3086950 | rs4908771 | hCV32055579 | rs6577522 | 0.51 | 0.532308891 | 0.8774 |
| hCV3086950 | rs4908771 | hCV32055595 | rs6577524 | 0.51 | 0.532308891 | 0.8774 |
| hCV3086950 | rs4908771 | hCV32055596 | rs6577525 | 0.51 | 0.532308891 | 0.8704 |
| hCV3086950 | rs4908771 | hCV32055625 | rs6678590 | 0.51 | 0.532308891 | 0.7684 |
| hCV3086950 | rs4908771 | hCV32055637 | rs6577532 | 0.51 | 0.532308891 | 0.8069 |
| hCV3086950 | rs4908771 | hCV32055662 | rs6677249 | 0.51 | 0.532308891 | 0.6372 |
| hCV3086950 | rs4908771 | hCV32055677 | rs10864355 | 0.51 | 0.532308891 | 0.8248 |
| hCV3086950 | rs4908771 | hCVS29178 | rs301811 | 0.51 | 0.532308891 | 0.8246 |
| hCV3086950 | rs4908771 | hCV529182 | rs301800 | 0.51 | 0.532308891 | 0.5758 |
| hCV3086950 | rs4908771 | hCV597227 | rs301809 | 0.51 | 0.532308891 | 0.8248 |
| hCV3086950 | rs4908771 | hCV597229 | rs301785 | 0.51 | 0.532308891 | 0.8248 |
| hCV3086950 | rs4908771 | hCV8823713 | rs1472228 | 0.51 | 0.532308891 | 0.8704 |
| hCV3086950 | rs4908771 | hCV8824248 | rs1543711 | 0.51 | 0.532308891 | 0.54 |
| hCV3086950 | rs4908771 | hCV8824288 | rs910582 | 0.51 | 0.532308891 | 0.8248 |
| hCV3086950 | rs4908771 | hCV8824424 | rs1058790 | 0.51 | 0.532308891 | 0.5975 |
| hCV3086950 | rs4908771 | hCV8824425 | rs1058791 | 0.51 | 0.532308891 | 0.5737 |
| hCV3086950 | rs4908771 | hCV8881145 | rs1038008 | 0.51 | 0.532308891 | 0.9381 |
| hCV3086950 | rs4908771 | hCV8881146 | rs1463054 | 0.51 | 0.532308891 | 0.9064 |
| hCV3086950 | rs4908771 | hCV8881157 | rs1535158 | 0.51 | 0.532308891 | 0.9381 |
| hCV3086950 | rs4908771 | hCV8881161 | rs926951 | 0.51 | 0.532308891 | 0.815 |
| hCV3086961 | rs6703577 | hCV11398434 | rs1812457 | 0.51 | 0.900934013 | 1 |
| hCV3086961 | rs6703577 | hCV11398437 | rs1817367 | 0.51 | 0.900934013 | 0.9642 |
| hCV3086961 | rs6703577 | hCV11675962 | rs10746481 | 0.51 | 0.900934013 | 0.9345 |
| hCV3086961 | rs6703577 | hCV27958354 | rs4908762 | 0.51 | 0.900934013 | 0.9379 |
| hCV3086961 | rs6703577 | hCV29819064 | rs6698079 | 0.51 | 0.900934013 | 1 |
| hCV3086961 | rs6703577 | hCV30143725 | rs6690050 | 0.51 | 0.900934013 | 0.9345 |
| hCV3086961 | rs6703577 | hCV30467730 | rs6702457 | 0.51 | 0.900934013 | 0.9345 |
| hCV3086961 | rs6703577 | hCV3086930 | rs6658881 | 0.51 | 0.900934013 | 0.9091 |
| hCV3086961 | rs6703577 | hCV3086932 | rs7533442 | 0.51 | 0.900934013 | 0.9091 |
| hCV3086961 | rs6703577 | hCV3086950 | rs4908771 | 0.51 | 0.900934013 | 0.9345 |
| hCV3086961 | rs6703577 | hCV3086971 | rs6679948 | 0.51 | 0.900934013 | 1 |
| hCV3086961 | rs6703577 | hCV3086972 | rs6688329 | 0.51 | 0.900934013 | 1 |
| hCV3086961 | rs6703577 | hCV3086998 | rs7530863 | 0.51 | 0.900934013 | 0.9379 |
| hCV3086961 | rs6703577 | hCV3087016 | rs2297867 | 0.51 | 0.900934013 | 0.9091 |
| hCV3086961 | rs6703577 | hCV32055470 | rs6577506 | 0.51 | 0.900934013 | 1 |
| hCV3086961 | rs6703577 | hCV32055474 | rs10864359 | 0.51 | 0.900934013 | 0.9379 |
| hCV3086961 | rs6703577 | hCV32055477 | rs10779705 | 0.51 | 0.900934013 | 1 |
| hCV3086961 | rs6703577 | hCV8881145 | rs1038008 | 0.51 | 0.900934013 | 1 |
| hCV3086961 | rs6703577 | hCV8881146 | rs1463054 | 0.51 | 0.900934013 | 1 |
| hCV3086961 | rs6703577 | hCV8881157 | rs1535158 | 0.51 | 0.900934013 | 1 |
| hCV3086961 | rs6703577 | hCV8881161 | rs926951 | 0.51 | 0.900934013 | 0.9379 |
| hCV3087000 | rs1463055 | hCV11398434 | rs1812457 | 0.51 | 0.532906869 | 0.8824 |
| hCV3087000 | rs1463055 | hCV11398437 | rs1817367 | 0.51 | 0.532906869 | 0.8638 |
| hCV3087000 | rs1463055 | hCV11675962 | rs10746481 | 0.51 | 0.532906869 | 0.8248 |
| hCV3087000 | rs1463055 | hCV1188731 | rs4908514 | 0.51 | 0.532906869 | 0.7112 |
| hCV3087000 | rs1463055 | hCV1188735 | rs10864366 | 0.51 | 0.532906869 | 0.6952 |
| hCV3087000 | rs1463055 | hCV15882429 | rs2289732 | 0.51 | 0.532906869 | 0.7153 |
| hCV3087000 | rs1463055 | hCV25996298 | rs7535752 | 0.51 | 0.532906869 | 0.5809 |
| hCV3087000 | rs1463055 | hCV27157507 | rs6664000 | 0.51 | 0.532906869 | 0.6952 |
| hCV3087000 | rs1463055 | hCV27157524 | rs6577531 | 0.51 | 0.532906869 | 0.6596 |
| hCV3087000 | rs1463055 | hCV2741759 | rs11121179 | 0.51 | 0.532906869 | 0.6996 |
| hCV3087000 | rs1463055 | hCV27474399 | rs3753275 | 0.51 | 0.532906869 | 0.5827 |
| hCV3087000 | rs1463055 | hCV27884601 | rs4908776 | 0.51 | 0.532906869 | 0.7103 |
| hCV3087000 | rs1463055 | hCV27958354 | rs4908762 | 0.51 | 0.532906869 | 1 |
| hCV3087000 | rs1463055 | hCV28023091 | rs4908773 | 0.51 | 0.532906869 | 0.6952 |
| hCV3087000 | rs1463055 | hCV29368919 | rs4908513 | 0.51 | 0.532906869 | 0.7112 |
| hCV3087000 | rs1463055 | hCV2943451 | rs902355 | 0.51 | 0.532906869 | 0.7442 |
| hCV3087000 | rs1463055 | hCV2943853 | rs301793 | 0.51 | 0.532906869 | 0.7153 |
| hCV3087000 | rs1463055 | hCV2966436 | rs11121174 | 0.51 | 0.532906869 | 0.7153 |
| hCV3087000 | rs1463055 | hCV2966437 | rs11580417 | 0.51 | 0.532906869 | 0.7153 |
| hCV3087000 | rs1463055 | hCV2966441 | rs6684863 | 0.51 | 0.532906869 | 0.7153 |
| hCV3087000 | rs1463055 | hCV2966444 | rs11121171 | 0.51 | 0.532906869 | 0.7672 |
| hCV3087000 | rs1463055 | hCV29819064 | rs6698079 | 0.51 | 0.532906869 | 0.8488 |
| hCV3087000 | rs1463055 | hCV2987250 | rs301810 | 0.51 | 0.532906869 | 0.7843 |
| hCV3087000 | rs1463055 | hCV29873524 | rs7533113 | 0.51 | 0.532906869 | 0.7112 |
| hCV3087000 | rs1463055 | hCV29873526 | rs6697997 | 0.51 | 0.532906869 | 1 |
| hCV3087000 | rs1463055 | hCV29945430 | rs7517436 | 0.51 | 0.532906869 | 0.6952 |
| hCV3087000 | rs1463055 | hCV30035535 | rs7518204 | 0.51 | 0.532906869 | 0.7101 |
| hCV3087000 | rs1463055 | hCV30125699 | rs4581300 | 0.51 | 0.532906869 | 1 |
| hCV3087000 | rs1463055 | hCV30143725 | rs6690050 | 0.51 | 0.532906869 | 0.8248 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV3087000 | rs1463055 | hCV30467730 | rs6702457 | 0.51 | 0.532906869 | 0.8248 |
| hCV3087000 | rs1463055 | hCV3086930 | rs6658881 | 0.51 | 0.532906869 | 0.815 |
| hCV3087000 | rs1463055 | hCV3086932 | rs7533442 | 0.51 | 0.532906869 | 0.815 |
| hCV3087000 | rs1463055 | hCV3086950 | rs4908771 | 0.51 | 0.532906869 | 0.8248 |
| hCV3087000 | rs1463055 | hCV3086961 | rs6703577 | 0.51 | 0.532906869 | 0.8759 |
| hCV3087000 | rs1463055 | hCV3086971 | rs6679948 | 0.51 | 0.532906869 | 0.8824 |
| hCV3087000 | rs1463055 | hCV3086972 | rs6688329 | 0.51 | 0.532906869 | 0.8759 |
| hCV3087000 | rs1463055 | hCV3086998 | rs7530863 | 0.51 | 0.532906869 | 1 |
| hCV3087000 | rs1463055 | hCV3087003 | rs6577500 | 0.51 | 0.532906869 | 1 |
| hCV3087000 | rs1463055 | hCV3087015 | rs11121198 | 0.51 | 0.532906869 | 1 |
| hCV3087000 | rs1463055 | hCV3087016 | rs2297867 | 0.51 | 0.532906869 | 1 |
| hCV3087000 | rs1463055 | hCV32055284 | rs12079653 | 0.51 | 0.532906869 | 0.6985 |
| hCV3087000 | rs1463055 | hCV32055470 | rs6577506 | 0.51 | 0.532906869 | 0.8759 |
| hCV3087000 | rs1463055 | hCV32055474 | rs10864359 | 0.51 | 0.532906869 | 0.8759 |
| hCV3087000 | rs1463055 | hCV32055477 | rs10779705 | 0.51 | 0.532906869 | 0.8824 |
| hCV3087000 | rs1463055 | hCV32055527 | rs10864364 | 0.51 | 0.532906869 | 0.6952 |
| hCV3087000 | rs1463055 | hCV32055548 | rs11121197 | 0.51 | 0.532906869 | 1 |
| hCV3087000 | rs1463055 | hCV32055579 | rs6577522 | 0.51 | 0.532906869 | 0.7109 |
| hCV3087000 | rs1463055 | hCV32055595 | rs6577524 | 0.51 | 0.532906869 | 0.7112 |
| hCV3087000 | rs1463055 | hCV32055596 | rs6577525 | 0.51 | 0.532906869 | 0.6952 |
| hCV3087000 | rs1463055 | hCV32055625 | rs6678590 | 0.51 | 0.532906869 | 0.6074 |
| hCV3087000 | rs1463055 | hCV32055637 | rs6577532 | 0.51 | 0.532906869 | 0.6408 |
| hCV3087000 | rs1463055 | hCV32055677 | rs10864355 | 0.51 | 0.532906869 | 1 |
| hCV3087000 | rs1463055 | hCV529178 | rs301811 | 0.51 | 0.532906869 | 1 |
| hCV3087000 | rs1463055 | hCVS29182 | rs301800 | 0.51 | 0.532906869 | 0.7545 |
| hCV3087000 | rs1463055 | hCV597227 | rs301809 | 0.51 | 0.532906869 | 1 |
| hCV3087000 | rs1463055 | hCV597229 | rs301785 | 0.51 | 0.532906869 | 1 |
| hCV3087000 | rs1463055 | hCV877241 | rs301788 | 0.51 | 0.532906869 | 0.6996 |
| hCV3087000 | rs1463055 | hCV8823713 | rs1472228 | 0.51 | 0.532906869 | 0.6952 |
| hCV3087000 | rs1463055 | hCV8824288 | rs910582 | 0.51 | 0.532906869 | 1 |
| hCV3087000 | rs1463055 | hCV8824394 | rs1443929 | 0.51 | 0.532906869 | 0.6996 |
| hCV3087000 | rs1463055 | hCV8824424 | rs1058790 | 0.51 | 0.532906869 | 0.7672 |
| hCV3087000 | rs1463055 | hCV8824425 | rs1058791 | 0.51 | 0.532906869 | 0.754 |
| hCV3087000 | rs1463055 | hCV8881145 | rs1038008 | 0.51 | 0.532906869 | 0.8824 |
| hCV3087000 | rs1463055 | hCV8881146 | rs1463054 | 0.51 | 0.532906869 | 0.8271 |
| hCV3087000 | rs1463055 | hCV8881157 | rs1535158 | 0.51 | 0.532906869 | 0.8824 |
| hCV3087000 | rs1463055 | hCV8881161 | rs926951 | 0.51 | 0.532906869 | 1 |
| hCV3087003 | rs6577500 | hCV27958354 | rs4908762 | 0.51 | 0.967969018 | 1 |
| hCV3087003 | rs6577500 | hCV29873526 | rs6677997 | 0.51 | 0.967969018 | 1 |
| hCV3087003 | rs6577500 | hCV30125699 | rs4581300 | 0.51 | 0.967969018 | 1 |
| hCV3087003 | rs6577500 | hCV3086998 | rs7530863 | 0.51 | 0.967969018 | 1 |
| hCV3087003 | rs6577500 | hCV3087000 | rs1463055 | 0.51 | 0.967969018 | 1 |
| hCV3087003 | rs6577500 | hCV3087015 | rs11121198 | 0.51 | 0.967969018 | 1 |
| hCV3087003 | rs6577500 | hCV3087016 | rs2297867 | 0.51 | 0.967969018 | 1 |
| hCV3087003 | rs6577500 | hCV32055548 | rs11121197 | 0.51 | 0.967969018 | 1 |
| hCV3087003 | rs6577500 | hCV32055677 | rs10864355 | 0.51 | 0.967969018 | 1 |
| hCV3087003 | rs6577500 | hCV529178 | rs301811 | 0.51 | 0.967969018 | 1 |
| hCV3087003 | rs6577500 | hCV597227 | rs301809 | 0.51 | 0.967969018 | 1 |
| hCV3087003 | rs6577500 | hCV597229 | rs301785 | 0.51 | 0.967969018 | 1 |
| hCV3087003 | rs6577500 | hCV8824288 | rs910582 | 0.51 | 0.967969018 | 1 |
| hCV3087003 | rs6577500 | hCV8881161 | rs926951 | 0.51 | 0.967969018 | 1 |
| hCV3087008 | rs12136689 | hCV11675387 | rs2120461 | 0.51 | 0.694720473 | 0.7177 |
| hCV3087008 | rs12136689 | hCV1265821 | rs6577489 | 0.51 | 0.694720473 | 0.9622 |
| hCV3087008 | rs12136689 | hCV1265845 | rs4908501 | 0.51 | 0.694720473 | 0.9607 |
| hCV3087008 | rs12136689 | hCV1417732 | rs12128827 | 0.51 | 0.694720473 | 0.8134 |
| hCV3087008 | rs12136689 | hCV2943852 | rs301795 | 0.51 | 0.694720473 | 0.7018 |
| hCV3087008 | rs12136689 | hCV2958030 | rs3765971 | 0.51 | 0.694720473 | 0.7018 |
| hCV3087008 | rs12136689 | hCV2958031 | rs2252865 | 0.51 | 0.694720473 | 0.7735 |
| hCV3087008 | rs12136689 | hCV2966430 | rs2708633 | 0.51 | 0.694720473 | 0.7018 |
| hCV3087008 | rs12136689 | hCV2966432 | rs6678140 | 0.51 | 0.694720473 | 0.7018 |
| hCV3087008 | rs12136689 | hCV2966435 | rs894875 | 0.51 | 0.694720473 | 0.7018 |
| hCV3087008 | rs12136689 | hCV2987217 | rs301791 | 0.51 | 0.694720473 | 0.7018 |
| hCV3087008 | rs12136689 | hCV2987218 | rs301790 | 0.51 | 0.694720473 | 0.7225 |
| hCV3087008 | rs12136689 | hCV2987219 | rs301789 | 0.51 | 0.694720473 | 0.7018 |
| hCV3087008 | rs12136689 | hCV2987237 | rs172531 | 0.51 | 0.694720473 | 0.7018 |
| hCV3087008 | rs12136689 | hCV2987238 | rs301801 | 0.51 | 0.694720473 | 0.7018 |
| hCV3087008 | rs12136689 | hCV3086955 | rs4908769 | 0.51 | 0.694720473 | 0.9612 |
| hCV3087008 | rs12136689 | hCV32055281 | rs10779702 | 0.51 | 0.694720473 | 0.7735 |
| hCV3087008 | rs12136689 | hCV32055303 | rs2784736 | 0.51 | 0.694720473 | 0.7018 |
| hCV3087008 | rs12136689 | hCV32055534 | rs12125525 | 0.51 | 0.694720473 | 0.8589 |
| hCV3087008 | rs12136689 | hCV32055581 | rs12123076 | 0.51 | 0.694720473 | 0.7789 |
| hCV3087008 | rs12136689 | hCV32055778 | rs6577497 | 0.51 | 0.694720473 | 0.8349 |
| hCV3087008 | rs12136689 | hCV8823613 | rs953043 | 0.51 | 0.694720473 | 0.8852 |
| hCV3087008 | rs12136689 | hCV8824315 | rs302719 | 0.51 | 0.694720473 | 0.7018 |
| hCV3087015 | rs11121198 | hCV11398434 | rs1812457 | 0.51 | 0.534576608 | 0.8824 |
| hCV3087015 | rs11121198 | hCV11398437 | rs1817367 | 0.51 | 0.534576608 | 0.8638 |
| hCV3087015 | rs11121198 | hCV11675962 | rs10746481 | 0.51 | 0.534576608 | 0.8248 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV3087015 | rs11121198 | hCV1188731 | rs4908514 | 0.51 | 0.534576608 | 0.7112 |
| hCV3087015 | rs11121198 | hCV1188735 | rs10864366 | 0.51 | 0.534576608 | 0.6952 |
| hCV3087015 | rs11121198 | hCV15882429 | rs2289732 | 0.51 | 0.534576608 | 0.7153 |
| hCV3087015 | rs11121198 | hCV25996298 | rs7535752 | 0.51 | 0.534576608 | 0.5809 |
| hCV3087015 | rs11121198 | hCV27157507 | rs6664000 | 0.51 | 0.534576608 | 0.6952 |
| hCV3087015 | rs11121198 | hCV27157524 | rs6577531 | 0.51 | 0.534576608 | 0.6596 |
| hCV3087015 | rs11121198 | hCV2741759 | rs11121179 | 0.51 | 0.534576608 | 0.6996 |
| hCV3087015 | rs11121198 | hCV27474399 | rs3753275 | 0.51 | 0.534576608 | 0.5827 |
| hCV3087015 | rs11121198 | hCV27884601 | rs4908776 | 0.51 | 0.534576608 | 0.7103 |
| hCV3087015 | rs11121198 | hCV27958354 | rs4908762 | 0.51 | 0.534576608 | 1 |
| hCV3087015 | rs11121198 | hCV28023091 | rs4908773 | 0.51 | 0.534576608 | 0.6952 |
| hCV3087015 | rs11121198 | hCV29368919 | rs4908513 | 0.51 | 0.534576608 | 0.7112 |
| hCV3087015 | rs11121198 | hCV2943451 | rs902355 | 0.51 | 0.534576608 | 0.7442 |
| hCV3087015 | rs11121198 | hCV2943853 | rs301793 | 0.51 | 0.534576608 | 0.7153 |
| hCV3087015 | rs11121198 | hCV2966436 | rs11121174 | 0.51 | 0.534576608 | 0.7153 |
| hCV3087015 | rs11121198 | hCV2966437 | rs11580417 | 0.51 | 0.534576608 | 0.7153 |
| hCV3087015 | rs11121198 | hCV2966441 | rs6684863 | 0.51 | 0.534576608 | 0.7153 |
| hCV3087015 | rs11121198 | hCV2966444 | rs11121171 | 0.51 | 0.534576608 | 0.7672 |
| hCV3087015 | rs11121198 | hCV29819064 | rs6698079 | 0.51 | 0.534576608 | 0.8488 |
| hCV3087015 | rs11121198 | hCV2987250 | rs301810 | 0.51 | 0.534576608 | 0.8909 |
| hCV3087015 | rs11121198 | hCV29873524 | rs7533113 | 0.51 | 0.534576608 | 0.7112 |
| hCV3087015 | rs11121198 | hCV29873526 | rs6697997 | 0.51 | 0.534576608 | 1 |
| hCV3087015 | rs11121198 | hCV29945430 | rs7517436 | 0.51 | 0.534576608 | 0.6952 |
| hCV3087015 | rs11121198 | hCV30035535 | rs7518204 | 0.51 | 0.534576608 | 0.7101 |
| hCV3087015 | rs11121198 | hCV30125699 | rs4581300 | 0.51 | 0.534576608 | 1 |
| hCV3087015 | rs11121198 | hCV30143725 | rs6690050 | 0.51 | 0.534576608 | 0.8248 |
| hCV3087015 | rs11121198 | hCV30467730 | rs6702457 | 0.51 | 0.534576608 | 0.8248 |
| hCV3087015 | rs11121198 | hCV3086930 | rs6658881 | 0.51 | 0.534576608 | 0.815 |
| hCV3087015 | rs11121198 | hCV3086932 | rs7533442 | 0.51 | 0.534576608 | 0.815 |
| hCV3087015 | rs11121198 | hCV3086950 | rs4908771 | 0.51 | 0.534576608 | 0.8248 |
| hCV3087015 | rs11121198 | hCV3086961 | rs6703577 | 0.51 | 0.534576608 | 0.8759 |
| hCV3087015 | rs11121198 | hCV3086971 | rs6679948 | 0.51 | 0.534576608 | 0.8824 |
| hCV3087015 | rs11121198 | hCV3086972 | rs6688329 | 0.51 | 0.534576608 | 0.8759 |
| hCV3087015 | rs11121198 | hCV3086998 | rs7530863 | 0.51 | 0.534576608 | 1 |
| hCV3087015 | rs11121198 | hCV3087000 | rs1463055 | 0.51 | 0.534576608 | 1 |
| hCV3087015 | rs11121198 | hCV3087003 | rs6577500 | 0.51 | 0.534576608 | 1 |
| hCV3087015 | rs11121198 | hCV3087016 | rs2297867 | 0.51 | 0.534576608 | 1 |
| hCV3087015 | rs11121198 | hCV32055284 | rs12079653 | 0.51 | 0.534576608 | 0.6985 |
| hCV3087015 | rs11121198 | hCV32055470 | rs6577506 | 0.51 | 0.534576608 | 0.8759 |
| hCV3087015 | rs11121198 | hCV32055474 | rs10864359 | 0.51 | 0.534576608 | 0.8759 |
| hCV3087015 | rs11121198 | hCV32055477 | rs10779705 | 0.51 | 0.534576608 | 0.8824 |
| hCV3087015 | rs11121198 | hCV32055527 | rs10864364 | 0.51 | 0.534576608 | 0.6952 |
| hCV3087015 | rs11121198 | hCV32055548 | rs11121197 | 0.51 | 0.534576608 | 1 |
| hCV3087015 | rs11121198 | hCV32055579 | rs6577522 | 0.51 | 0.534576608 | 0.7109 |
| hCV3087015 | rs11121198 | hCV32055595 | rs6577524 | 0.51 | 0.534576608 | 0.7112 |
| hCV3087015 | rs11121198 | hCV32055596 | rs6577525 | 0.51 | 0.534576608 | 0.6952 |
| hCV3087015 | rs11121198 | hCV32055625 | rs6678590 | 0.51 | 0.534576608 | 0.6074 |
| hCV3087015 | rs11121198 | hCV32055637 | rs6577532 | 0.51 | 0.534576608 | 0.6408 |
| hCV3087015 | rs11121198 | hCV32055677 | rs10864355 | 0.51 | 0.534576608 | 1 |
| hCV3087015 | rs11121198 | hCV529178 | rs301811 | 0.51 | 0.534576608 | 1 |
| hCV3087015 | rs11121198 | hCV529182 | rs301800 | 0.51 | 0.534576608 | 0.7545 |
| hCV3087015 | rs11121198 | hCV597227 | rs301809 | 0.51 | 0.534576608 | 1 |
| hCV3087015 | rs11121198 | hCV597229 | rs301785 | 0.51 | 0.534576608 | 1 |
| hCV3087015 | rs11121198 | hCV877241 | rs301788 | 0.51 | 0.534576608 | 0.6996 |
| hCV3087015 | rs11121198 | hCV8823713 | rs1472228 | 0.51 | 0.534576608 | 0.6952 |
| hCV3087015 | rs11121198 | hCV8824288 | rs910582 | 0.51 | 0.534576608 | 1 |
| hCV3087015 | rs11121198 | hCV8824394 | rs1443929 | 0.51 | 0.534576608 | 0.6996 |
| hCV3087015 | rs11121198 | hCV8824424 | rs1058790 | 0.51 | 0.534576608 | 0.7672 |
| hCV3087015 | rs11121198 | hCV8824425 | rs1058791 | 0.51 | 0.534576608 | 0.754 |
| hCV3087015 | rs11121198 | hCV8881145 | rs1038008 | 0.51 | 0.534576608 | 0.8824 |
| hCV3087015 | rs11121198 | hCV8881146 | rs1463054 | 0.51 | 0.534576608 | 0.8271 |
| hCV3087015 | rs11121198 | hCV8881157 | rs1535158 | 0.51 | 0.534576608 | 0.8824 |
| hCV3087015 | rs11121198 | hCV8881161 | rs926951 | 0.51 | 0.534576608 | 1 |
| hCV3087016 | rs2297867 | hCV27958354 | rs4908762 | 0.51 | 0.936425384 | 0.9694 |
| hCV3087016 | rs2297867 | hCV29873526 | rs6697997 | 0.51 | 0.936425384 | 1 |
| hCV3087016 | rs2297867 | hCV3086998 | rs7530863 | 0.51 | 0.936425384 | 0.9694 |
| hCV3087016 | rs2297867 | hCV3087000 | rs1463055 | 0.51 | 0.936425384 | 1 |
| hCV3087016 | rs2297867 | hCV3087003 | rs6577500 | 0.51 | 0.936425384 | 1 |
| hCV3087016 | rs2297867 | hCV3087015 | rs11121198 | 0.51 | 0.936425384 | 1 |
| hCV3087016 | rs2297867 | hCV32055548 | rs11121197 | 0.51 | 0.936425384 | 1 |
| hCV3087016 | rs2297867 | hCV32055677 | rs10864355 | 0.51 | 0.936425384 | 1 |
| hCV3087016 | rs2297867 | hCV529178 | rs301811 | 0.51 | 0.936425384 | 1 |
| hCV3087016 | rs2297867 | hCV597227 | rs301809 | 0.51 | 0.936425384 | 1 |
| hCV3087016 | rs2297867 | hCV597229 | rs301785 | 0.51 | 0.936425384 | 1 |
| hCV3087016 | rs2297867 | hCV8824288 | rs910582 | 0.51 | 0.936425384 | 1 |
| hCV3087016 | rs2297867 | hCV8881161 | rs926951 | 0.51 | 0.936425384 | 0.9694 |
| hCV31145250 | rs10889353 | hCV11864156 | rs10889334 | 0.51 | 0.9 | 1 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV31145250 | rs10889353 | hCV11864162 | rs1167998 | 0.51 | 0.9 | 0.9585 |
| hCV31145250 | rs10889353 | hCV11865171 | rs11208004 | 0.51 | 0.9 | 1 |
| hCV31145250 | rs10889353 | hCV11865185 | rs10789117 | 0.51 | 0.9 | 0.979 |
| hCV31145250 | rs10889353 | hCV11865201 | rs10159255 | 0.51 | 0.9 | 0.979 |
| hCV31145250 | rs10889353 | hCV12103105 | rs1184865 | 0.51 | 0.9 | 0.9585 |
| hCV31145250 | rs10889353 | hCV12103127 | rs1979722 | 0.51 | 0.9 | 0.9789 |
| hCV31145250 | rs10889353 | hCV12103499 | rs2029763 | 0.51 | 0.9 | 1 |
| hCV31145250 | rs10889353 | hCV12103502 | rs1168023 | 0.51 | 0.9 | 0.958 |
| hCV31145250 | rs10889353 | hCV1236535 | rs1168042 | 0.51 | 0.9 | 0.959 |
| hCV31145250 | rs10889353 | hCV149783 | rs1168045 | 0.51 | 0.9 | 0.979 |
| hCV31145250 | rs10889353 | hCV16214290 | rs2366638 | 0.51 | 0.9 | 0.959 |
| hCV31145250 | rs10889353 | hCV1778957 | rs3913007 | 0.51 | 0.9 | 1 |
| hCV31145250 | rs10889353 | hCV1778958 | rs634341 | 0.51 | 0.9 | 0.9558 |
| hCV31145250 | rs10889353 | hCV1778963 | rs10158897 | 0.51 | 0.9 | 0.979 |
| hCV31145250 | rs10889353 | hCV1778964 | rs659656 | 0.51 | 0.9 | 1 |
| hCV31145250 | rs10889353 | hCV1778965 | rs637723 | 0.51 | 0.9 | 0.9585 |
| hCV31145250 | rs10889353 | hCV1918028 | rs10157265 | 0.51 | 0.9 | 0.958 |
| hCV31145250 | rs10889353 | hCV1918041 | rs4587594 | 0.51 | 0.9 | 1 |
| hCV31145250 | rs10889353 | hCV1918054 | rs10889347 | 0.51 | 0.9 | 0.979 |
| hCV31145250 | rs10889353 | hCV2015148 | rs11208007 | 0.51 | 0.9 | 0.9032 |
| hCV31145250 | rs10889353 | hCV25971202 | rs10889335 | 0.51 | 0.9 | 0.9585 |
| hCV31145250 | rs10889353 | hCV26412183 | rs1748199 | 0.51 | 0.9 | 0.9577 |
| hCV31145250 | rs10889353 | hCV26412184 | rs11207990 | 0.51 | 0.9 | 0.9521 |
| hCV31145250 | rs10889353 | hCV27320451 | rs4350231 | 0.51 | 0.9 | 0.979 |
| hCV31145250 | rs10889353 | hCV27320465 | rs641540 | 0.51 | 0.9 | 0.9586 |
| hCV31145250 | rs10889353 | hCV29103721 | rs6678483 | 0.51 | 0.9 | 0.979 |
| hCV31145250 | rs10889353 | hCV29103722 | rs6675401 | 0.51 | 0.9 | 0.979 |
| hCV31145250 | rs10889353 | hCV29103723 | rs4329540 | 0.51 | 0.9 | 0.979 |
| hCV31145250 | rs10889353 | hCV29647381 | rs6690733 | 0.51 | 0.9 | 0.9585 |
| hCV31145250 | rs10889353 | hCV29749081 | rs10493322 | 0.51 | 0.9 | 1 |
| hCV31145250 | rs10889353 | hCV30224093 | rs7539035 | 0.51 | 0.9 | 0.979 |
| hCV31145250 | rs10889353 | hCV31145255 | rs11208000 | 0.51 | 0.9 | 0.9551 |
| hCV31145250 | rs10889353 | hCV31145262 | rs10889352 | 0.51 | 0.9 | 1 |
| hCV31145250 | rs10889353 | hCV31145264 | rs10789119 | 0.51 | 0.9 | 1 |
| hCV31145250 | rs10889353 | hCV31145266 | rs10789118 | 0.51 | 0.9 | 1 |
| hCV31145250 | rs10889353 | hCV31145267 | rs11485618 | 0.51 | 0.9 | 1 |
| hCV31145250 | rs10889353 | hCV31145269 | rs6587980 | 0.51 | 0.9 | 0.979 |
| hCV31145250 | rs10889353 | hCV31145277 | rs10889350 | 0.51 | 0.9 | 0.959 |
| hCV31145250 | rs10889353 | hCV31145279 | rs10889349 | 0.51 | 0.9 | 0.959 |
| hCV31145250 | rs10889353 | hCV31145282 | rs11207997 | 0.51 | 0.9 | 0.9169 |
| hCV31145250 | rs10889353 | hCV31145290 | rs12042319 | 0.51 | 0.9 | 1 |
| hCV31145250 | rs10889353 | hCV31145291 | rs11207995 | 0.51 | 0.9 | 0.9789 |
| hCV31145250 | rs10889353 | hCV31145298 | rs11207992 | 0.51 | 0.9 | 1 |
| hCV31145250 | rs10889353 | hCV31145302 | rs12116574 | 0.51 | 0.9 | 1 |
| hCV31145250 | rs10889353 | hCV31145332 | rs11207981 | 0.51 | 0.9 | 0.9538 |
| hCV31145250 | rs10889353 | hCV3122390 | rs1748200 | 0.51 | 0.9 | 0.959 |
| hCV31145250 | rs10889353 | hCV316299 | rs1168026 | 0.51 | 0.9 | 0.959 |
| hCV31145250 | rs10889353 | hCV316303 | rs1168031 | 0.51 | 0.9 | 0.9586 |
| hCV31145250 | rs10889353 | hCV32220452 | rs12090886 | 0.51 | 0.9 | 1 |
| hCV31145250 | rs10889353 | hCV32220453 | rs10889337 | 0.51 | 0.9 | 0.9585 |
| hCV31145250 | rs10889353 | hCV32220467 | rs10889333 | 0.51 | 0.9 | 1 |
| hCV31145250 | rs10889353 | hCV32220469 | rs10889332 | 0.51 | 0.9 | 0.979 |
| hCV31145250 | rs10889353 | hCV32220470 | rs11207974 | 0.51 | 0.9 | 0.959 |
| hCV31145250 | rs10889353 | hCV32220491 | rs11577840 | 0.51 | 0.9 | 0.9586 |
| hCV31145250 | rs10889353 | hCV32220495 | rs11207969 | 0.51 | 0.9 | 0.979 |
| hCV31145250 | rs10889353 | hCV408090 | rs1183260 | 0.51 | 0.9 | 0.9566 |
| hCV31145250 | rs10889353 | hCV445207 | rs1627591 | 0.51 | 0.9 | 0.959 |
| hCV31145250 | rs10889353 | hCV71419 | rs2131925 | 0.51 | 0.9 | 0.959 |
| hCV31145250 | rs10889353 | hCV857102 | rs624660 | 0.51 | 0.9 | 0.979 |
| hCV31145250 | rs10889353 | hCV857103 | rs636497 | 0.51 | 0.9 | 0.9577 |
| hCV31145250 | rs10889353 | hCV857104 | rs636523 | 0.51 | 0.9 | 1 |
| hCV31145250 | rs10889353 | hCV857108 | rs597078 | 0.51 | 0.9 | 0.958 |
| hCV31145250 | rs10889353 | hCV857109 | rs597470 | 0.51 | 0.9 | 0.959 |
| hCV31145250 | rs10889353 | hCV857110 | rs583609 | 0.51 | 0.9 | 0.979 |
| hCV31145250 | rs10889353 | hCV857121 | rs642845 | 0.51 | 0.9 | 0.958 |
| hCV31145250 | rs10889353 | hCV857122 | rs656297 | 0.51 | 0.9 | 0.979 |
| hCV31145250 | rs10889353 | hCV857123 | rs638305 | 0.51 | 0.9 | 0.959 |
| hCV31145250 | rs10889353 | hCV857127 | rs631106 | 0.51 | 0.9 | 0.9577 |
| hCV31145250 | rs10889353 | hCV9508668 | rs1781195 | 0.51 | 0.9 | 0.979 |
| hCV31145250 | rs10889353 | hCV9581062 | rs998403 | 0.51 | 0.9 | 1 |
| hCV31145250 | rs10889353 | hCV9581570 | rs1168036 | 0.51 | 0.9 | 1 |
| hCV31145250 | rs10889353 | hCV9581571 | rs1002687 | 0.51 | 0.9 | 0.959 |
| hCV31145250 | rs10889353 | hCV9581580 | rs1168032 | 0.51 | 0.9 | 0.958 |
| hCV31145250 | rs10889353 | hCV9581581 | rs1168030 | 0.51 | 0.9 | 0.959 |
| hCV31145250 | rs10889353 | hCV9581590 | rs1168018 | 0.51 | 0.9 | 0.9789 |
| hCV31145250 | rs10889353 | hCV9581606 | rs1168022 | 0.51 | 0.9 | 0.9558 |
| hCV31145250 | rs10889353 | hCV9581615 | rs1748201 | 0.51 | 0.9 | 0.9789 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV31145250 | rs10889353 | hCV9581635 | rs1748195 | 0.51 | 0.9 | 0.979 |
| hCV31145250 | rs10889353 | hCV9581636 | rs3850634 | 0.51 | 0.9 | 1 |
| hCV31145250 | rs10889353 | hCV9581680 | rs1748197 | 0.51 | 0.9 | 0.959 |
| hCV31145250 | rs10889353 | hCV9581691 | rs1570694 | 0.51 | 0.9 | 1 |
| hCV31145250 | rs10889353 | hCV9583244 | rs783291 | 0.51 | 0.9 | 0.959 |
| hCV31145250 | rs10889353 | hCV9588770 | rs1007205 | 0.51 | 0.9 | 0.959 |
| hCV31145250 | rs10889353 | hCV9588793 | rs1168009 | 0.51 | 0.9 | 0.9365 |
| hCV31145250 | rs10889353 | hCV9588794 | rs1168010 | 0.51 | 0.9 | 0.936 |
| hCV31145250 | rs10889353 | hCV9588829 | rs1781212 | 0.51 | 0.9 | 0.959 |
| hCV31145250 | rs10889353 | hCV9588850 | rs1168013 | 0.51 | 0.9 | 0.979 |
| hCV31145250 | rs10889353 | hCV9588862 | rs995000 | 0.51 | 0.9 | 1 |
| hCV31145250 | rs10889353 | hCV9588875 | rs1168086 | 0.51 | 0.9 | 0.9551 |
| hCV31145250 | rs10889353 | hCV9588886 | rs1168089 | 0.51 | 0.9 | 0.979 |
| hCV31145250 | rs10889353 | hCV9588930 | rs1168099 | 0.51 | 0.9 | 0.979 |
| hCV31145250 | rs10889353 | hCV9588985 | rs1168124 | 0.51 | 0.9 | 0.959 |
| hCV31145250 | rs10889353 | hDV75176134 | rs1781221 | 0.51 | 0.9 | 0.959 |
| hCV31161091 | rs3127573 | hCV16149755 | rs2183470 | 0.51 | 0.665154887 | 0.776 |
| hCV31161091 | rs3127573 | hCV27397381 | rs3120149 | 0.51 | 0.665154887 | 0.7457 |
| hCV31161091 | rs3127573 | hCV27403525 | rs3119309 | 0.51 | 0.665154887 | 0.9549 |
| hCV31161091 | rs3127573 | hCV27459536 | rs3119310 | 0.51 | 0.665154887 | 1 |
| hCV31161091 | rs3127573 | hCV27460260 | rs3119311 | 0.51 | 0.665154887 | 0.9549 |
| hCV31161091 | rs3127573 | hCV27461119 | rs3125056 | 0.51 | 0.665154887 | 0.7 |
| hCV31161091 | rs3127573 | hCV27462007 | rs3127578 | 0.51 | 0.665154887 | 1 |
| hCV31161091 | rs3127573 | hCV27464241 | rs3125052 | 0.51 | 0.665154887 | 0.776 |
| hCV31161091 | rs3127573 | hCV27464790 | rs3127591 | 0.51 | 0.665154887 | 0.7283 |
| hCV31161091 | rs3127573 | hCV27517953 | rs3798156 | 0.51 | 0.665154887 | 0.6692 |
| hCV31161091 | rs3127573 | hCV30977817 | rs3106168 | 0.51 | 0.665154887 | 0.7755 |
| hCV31161091 | rs3127573 | hCV30977839 | rs3120140 | 0.51 | 0.665154887 | 0.8656 |
| hCV31161091 | rs3127573 | hCV30977855 | rs3103350 | 0.51 | 0.665154887 | 0.776 |
| hCV31161091 | rs3127573 | hCV30977859 | rs12209517 | 0.51 | 0.665154887 | 0.8649 |
| hCV31161091 | rs3127573 | hCV3111820 | rs3127572 | 0.51 | 0.665154887 | 1 |
| hCV31161091 | rs3127573 | hCV31605072 | rs12206585 | 0.51 | 0.665154887 | 0.7457 |
| hCV31161091 | rs3127573 | hCV31605081 | rs12203303 | 0.51 | 0.665154887 | 0.7833 |
| hCV31161091 | rs3127573 | hDV71058825 | rs7757336 | 0.51 | 0.665154887 | 0.6683 |
| hCV31161091 | rs3127573 | hDV71669191 | rs3127586 | 0.51 | 0.665154887 | 0.8397 |
| hCV31161091 | rs3127573 | hDV71967259 | rs7756836 | 0.51 | 0.665154887 | 0.9549 |
| hCV31161091 | rs3127573 | hDV75428625 | rs3106167 | 0.51 | 0.665154887 | 0.776 |
| hCV31161091 | rs3127573 | hDV75428626 | rs3106170 | 0.51 | 0.665154887 | 0.7452 |
| hCV31161091 | rs3127573 | hDV75428628 | rs3106172 | 0.51 | 0.665154887 | 0.816 |
| hCV31161091 | rs3127573 | hDV75431938 | rs3120151 | 0.51 | 0.665154887 | 0.776 |
| hCV31161091 | rs3127573 | hDV75433616 | rs3125049 | 0.51 | 0.665154887 | 0.72 |
| hCV31237961 | rs11950562 | hCV26479157 | rs2631360 | 0.51 | 0.9 | 1 |
| hCV31237961 | rs11950562 | hCV28006893 | rs4705938 | 0.51 | 0.9 | 1 |
| hCV31237961 | rs11950562 | hCV29828916 | rs10058074 | 0.51 | 0.9 | 1 |
| hCV31237961 | rs11950562 | hDV70978086 | rs17622208 | 0.51 | 0.9 | 1 |
| hCV3135085 | rs10795446 | hCV11453231 | rs12764449 | 0.51 | 0.9 | 1 |
| hCV3135085 | rs10795446 | hCV26740575 | rs12263745 | 0.51 | 0.9 | 0.9603 |
| hCV3135085 | rs10795446 | hCV2822668 | rs10904880 | 0.51 | 0.9 | 0.9602 |
| hCV3135085 | rs10795446 | hCV2822671 | rs7900434 | 0.51 | 0.9 | 0.9794 |
| hCV3135085 | rs10795446 | hCV2822672 | rs7900428 | 0.51 | 0.9 | 0.9169 |
| hCV3135085 | rs10795446 | hCV2822673 | rs7900190 | 0.51 | 0.9 | 0.9793 |
| hCV3135085 | rs10795446 | hCV3135082 | rs7921322 | 0.51 | 0.9 | 1 |
| hCV3135085 | rs10795446 | hCV3135091 | rs4748355 | 0.51 | 0.9 | 0.9598 |
| hCV31528409 | rs7635061 | hCV251046 | rs4075158 | 0.51 | 0.9 | 1 |
| hCV31528409 | rs7635061 | hCV31746376 | rs12494136 | 0.51 | 0.9 | 1 |
| hCV31528409 | rs7635061 | hCV439262 | rs8179973 | 0.51 | 0.9 | 0.9109 |
| hCV31528409 | rs7635061 | hCV439263 | rs8180032 | 0.51 | 0.9 | 0.9051 |
| hCV3168675 | rs469930 | hCV984679 | rs467650 | 0.51 | 0.9 | 0.9781 |
| hCV3168675 | rs469930 | hCV984683 | rs468238 | 0.51 | 0.9 | 1 |
| hCV3168675 | rs469930 | hCV984684 | rs154197 | 0.51 | 0.9 | 1 |
| hCV3170445 | rs272893 | hCV1173593 | rs274567 | 0.51 | 0.9 | 1 |
| hCV3170445 | rs272893 | hCV1173600 | rs274562 | 0.51 | 0.9 | 1 |
| hCV3170445 | rs272893 | hCV1173605 | rs274559 | 0.51 | 0.9 | 0.9612 |
| hCV3170445 | rs272893 | hCV2390950 | rs274546 | 0.51 | 0.9 | 0.9804 |
| hCV3170445 | rs272893 | hCV2390957 | rs272894 | 0.51 | 0.9 | 0.9612 |
| hCV3170445 | rs272893 | hCV26479192 | rs272865 | 0.51 | 0.9 | 0.922 |
| hCV3170445 | rs272893 | hCV2843383 | rs2631370 | 0.51 | 0.9 | 0.9612 |
| hCV3170445 | rs272893 | hCV2843392 | rs272884 | 0.51 | 0.9 | 0.9612 |
| hCV3170445 | rs272893 | hCV2843394 | rs272881 | 0.51 | 0.9 | 0.9612 |
| hCV3170445 | rs272893 | hCV2843395 | rs272879 | 0.51 | 0.9 | 0.96 |
| hCV3170445 | rs272893 | hCV2950035 | rs419291 | 0.51 | 0.9 | 0.9804 |
| hCV3170445 | rs272893 | hCV3170430 | rs270613 | 0.51 | 0.9 | 0.9408 |
| hCV3170445 | rs272893 | hCV3170440 | rs270605 | 0.51 | 0.9 | 0.9612 |
| hCV3170445 | rs272893 | hCV3170442 | rs273914 | 0.51 | 0.9 | 0.9097 |
| hCV3170445 | rs272893 | hCV3170446 | rs272889 | 0.51 | 0.9 | 1 |
| hCV3170445 | rs272893 | hCV3170448 | rs272886 | 0.51 | 0.9 | 0.9612 |
| hCV3170445 | rs272893 | hCV3170453 | rs272875 | 0.51 | 0.9 | 0.9612 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV3170445 | rs272893 | hCV3170454 | rs272874 | 0.51 | 0.9 | 1 |
| hCV3170445 | rs272893 | hCV3170461 | rs272869 | 0.51 | 0.9 | 1 |
| hCV3170445 | rs272893 | hCV3170463 | rs4705933 | 0.51 | 0.9 | 0.9612 |
| hCV3170445 | rs272893 | hCV3170466 | rs272867 | 0.51 | 0.9 | 0.9612 |
| hCV3170445 | rs272893 | hCV3281569 | rs272842 | 0.51 | 0.9 | 0.9612 |
| hCV3170445 | rs272893 | hCV3281570 | rs270602 | 0.51 | 0.9 | 1 |
| hCV3170445 | rs272893 | hCV559622 | rs274561 | 0.51 | 0.9 | 1 |
| hCV3170445 | rs272893 | hCV559623 | rs274560 | 0.51 | 0.9 | 1 |
| hCV3170445 | rs272893 | hCV559624 | rs274558 | 0.51 | 0.9 | 0.9612 |
| hCV3170445 | rs272893 | hCV559625 | rs274557 | 0.51 | 0.9 | 0.9612 |
| hCV3170445 | rs272893 | hCV9157871 | rs272860 | 0.51 | 0.9 | 0.9589 |
| hCV3170445 | rs272893 | hCV9158012 | rs273913 | 0.51 | 0.9 | 0.9612 |
| hCV3170459 | rs1050152 | hCV15849790 | rs2188962 | 0.51 | 0.9 | 0.9412 |
| hCV3170459 | rs1050152 | hCV2554569 | rs11951091 | 0.51 | 0.9 | 0.9644 |
| hCV3170459 | rs1050152 | hCV2554615 | rs2522057 | 0.51 | 0.9 | 0.9037 |
| hCV3170459 | rs1050152 | hCV2554620 | rs2248116 | 0.51 | 0.9 | 0.9027 |
| hCV3170459 | rs1050152 | hCV31237908 | rs12515180 | 0.51 | 0.9 | 0.9624 |
| hCV3170459 | rs1050152 | hCV31237910 | rs12521868 | 0.51 | 0.9 | 0.9409 |
| hCV3170459 | rs1050152 | hCV3281563 | rs11741255 | 0.51 | 0.9 | 0.9226 |
| hCV3170459 | rs1050152 | hDV70978119 | rs17622378 | 0.51 | 0.9 | 0.9639 |
| hCV3201490 | rs1321195 | hCV103951 | rs6455688 | 0.51 | 0.325832601 | 0.3951 |
| hCV3201490 | rs1321195 | hCV103952 | rs6923877 | 0.51 | 0.325832601 | 0.3951 |
| hCV3201490 | rs1321195 | hCV11284288 | rs9457946 | 0.51 | 0.325832601 | 0.3442 |
| hCV3201490 | rs1321195 | hCV11285578 | rs6926458 | 0.51 | 0.325832601 | 0.6014 |
| hCV3201490 | rs1321195 | hCV11846435 | rs6929299 | 0.51 | 0.325832601 | 0.3278 |
| hCV3201490 | rs1321195 | hCV1550871 | rs9355295 | 0.51 | 0.325832601 | 0.3554 |
| hCV3201490 | rs1321195 | hCV15975022 | rs2314852 | 0.51 | 0.325832601 | 0.3961 |
| hCV3201490 | rs1321195 | hCV207123 | rs7771801 | 0.51 | 0.325832601 | 0.3429 |
| hCV3201490 | rs1321195 | hCV207127 | rs7453899 | 0.51 | 0.325832601 | 0.3635 |
| hCV3201490 | rs1321195 | hCV207128 | rs6455689 | 0.51 | 0.325832601 | 0.3635 |
| hCV3201490 | rs1321195 | hCV243055 | rs10945682 | 0.51 | 0.325832601 | 0.3278 |
| hCV3201490 | rs1321195 | hCV249898 | rs9456552 | 0.51 | 0.325832601 | 0.3355 |
| hCV3201490 | rs1321195 | hCV25927459 | rs3798221 | 0.51 | 0.325832601 | 0.6526 |
| hCV3201490 | rs1321195 | hCV25929408 | rs7765781 | 0.51 | 0.325832601 | 0.3554 |
| hCV3201490 | rs1321195 | hCV25929478 | rs7765803 | 0.51 | 0.325832601 | 0.3635 |
| hCV3201490 | rs1321195 | hCV26272388 | rs7770685 | 0.51 | 0.325832601 | 0.6129 |
| hCV3201490 | rs1321195 | hCV26272389 | rs7760585 | 0.51 | 0.325832601 | 0.3278 |
| hCV3201490 | rs1321195 | hCV27422538 | rs6940254 | 0.51 | 0.325832601 | 0.6 |
| hCV3201490 | rs1321195 | hCV27422546 | rs7761377 | 0.51 | 0.325832601 | 0.3287 |
| hCV3201490 | rs1321195 | hCV27422554 | rs6923917 | 0.51 | 0.325832601 | 0.3278 |
| hCV3201490 | rs1321195 | hCV27422556 | rs9355814 | 0.51 | 0.325832601 | 0.3325 |
| hCV3201490 | rs1321195 | hCV27422557 | rs9355813 | 0.51 | 0.325832601 | 0.3283 |
| hCV3201490 | rs1321195 | hCV27422565 | rs13202636 | 0.51 | 0.325832601 | 0.6129 |
| hCV3201490 | rs1321195 | hCV29322781 | rs6921516 | 0.51 | 0.325832601 | 0.3635 |
| hCV3201490 | rs1321195 | hCV29546641 | rs9365171 | 0.51 | 0.325832601 | 0.3342 |
| hCV3201490 | rs1321195 | hCV29998162 | rs9457943 | 0.51 | 0.325832601 | 0.3554 |
| hCV3201490 | rs1321195 | hCV31882494 | rs12175867 | 0.51 | 0.325832601 | 0.6 |
| hCV3201490 | rs1321195 | hCV3201494 | rs1367209 | 0.51 | 0.325832601 | 0.4687 |
| hCV3201490 | rs1321195 | hCV3201495 | rs1367210 | 0.51 | 0.325832601 | 1 |
| hCV3201490 | rs1321195 | hCV3201497 | rs1321196 | 0.51 | 0.325832601 | 0.3278 |
| hCV3201490 | rs1321195 | hCV8701273 | rs783148 | 0.51 | 0.325832601 | 1 |
| hCV3201490 | rs1321195 | hCV8710161 | rs1740428 | 0.51 | 0.325832601 | 0.3278 |
| hCV3201490 | rs1321195 | hCV8710162 | rs1367211 | 0.51 | 0.325832601 | 0.4687 |
| hCV32055474 | rs10864359 | hCV11398434 | rs1812457 | 0.51 | 0.5160794 | 1 |
| hCV32055474 | rs10864359 | hCV11398437 | rs1817367 | 0.51 | 0.5160794 | 0.8987 |
| hCV32055474 | rs10864359 | hCV11675962 | rs10746481 | 0.51 | 0.5160794 | 0.9345 |
| hCV32055474 | rs10864359 | hCV1188731 | rs4908514 | 0.51 | 0.5160794 | 0.7979 |
| hCV32055474 | rs10864359 | hCV1188735 | rs10864366 | 0.51 | 0.5160794 | 0.6717 |
| hCV32055474 | rs10864359 | hCV15882429 | rs2289732 | 0.51 | 0.5160794 | 0.5747 |
| hCV32055474 | rs10864359 | hCV15932991 | rs2781067 | 0.51 | 0.5160794 | 0.5621 |
| hCV32055474 | rs10864359 | hCV27157507 | rs6664000 | 0.51 | 0.5160794 | 0.6717 |
| hCV32055474 | rs10864359 | hCV27157524 | rs6577531 | 0.51 | 0.5160794 | 0.7394 |
| hCV32055474 | rs10864359 | hCV2741759 | rs11121179 | 0.51 | 0.5160794 | 0.5606 |
| hCV32055474 | rs10864359 | hCV27884601 | rs4908776 | 0.51 | 0.5160794 | 0.7973 |
| hCV32055474 | rs10864359 | hCV27958354 | rs4908762 | 0.51 | 0.5160794 | 0.8778 |
| hCV32055474 | rs10864359 | hCV28023091 | rs4908773 | 0.51 | 0.5160794 | 0.6717 |
| hCV32055474 | rs10864359 | hCV29368919 | rs4908513 | 0.51 | 0.5160794 | 0.7979 |
| hCV32055474 | rs10864359 | hCV2943451 | rs902355 | 0.51 | 0.5160794 | 0.6535 |
| hCV32055474 | rs10864359 | hCV2943853 | rs301793 | 0.51 | 0.5160794 | 0.5747 |
| hCV32055474 | rs10864359 | hCV2966436 | rs11121174 | 0.51 | 0.5160794 | 0.5747 |
| hCV32055474 | rs10864359 | hCV2966437 | rs11580417 | 0.51 | 0.5160794 | 0.5747 |
| hCV32055474 | rs10864359 | hCV2966441 | rs6684863 | 0.51 | 0.5160794 | 0.5747 |
| hCV32055474 | rs10864359 | hCV2966444 | rs11121171 | 0.51 | 0.5160794 | 0.6208 |
| hCV32055474 | rs10864359 | hCV29819064 | rs6698079 | 0.51 | 0.5160794 | 1 |
| hCV32055474 | rs10864359 | hCV2987250 | rs301810 | 0.51 | 0.5160794 | 0.665 |
| hCV32055474 | rs10864359 | hCV29873524 | rs7533113 | 0.51 | 0.5160794 | 0.7979 |
| hCV32055474 | rs10864359 | hCV29873526 | rs6697997 | 0.51 | 0.5160794 | 0.8759 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV32055474 | rs10864359 | hCV29945430 | rs7517436 | 0.51 | 0.5160794 | 0.6717 |
| hCV32055474 | rs10864359 | hCV30035535 | rs7518204 | 0.51 | 0.5160794 | 0.7971 |
| hCV32055474 | rs10864359 | hCV30125699 | rs4581300 | 0.51 | 0.5160794 | 0.8169 |
| hCV32055474 | rs10864359 | hCV30143725 | rs6690050 | 0.51 | 0.5160794 | 0.9345 |
| hCV32055474 | rs10864359 | hCV30467730 | rs6702457 | 0.51 | 0.5160794 | 0.9345 |
| hCV32055474 | rs10864359 | hCV3086930 | rs6658881 | 0.51 | 0.5160794 | 0.85 |
| hCV32055474 | rs10864359 | hCV3086932 | rs7533442 | 0.51 | 0.5160794 | 0.85 |
| hCV32055474 | rs10864359 | hCV3086950 | rs4908771 | 0.51 | 0.5160794 | 0.9345 |
| hCV32055474 | rs10864359 | hCV3086961 | rs6703577 | 0.51 | 0.5160794 | 0.9379 |
| hCV32055474 | rs10864359 | hCV3086971 | rs6679948 | 0.51 | 0.5160794 | 1 |
| hCV32055474 | rs10864359 | hCV3086972 | rs6688329 | 0.51 | 0.5160794 | 1 |
| hCV32055474 | rs10864359 | hCV3086998 | rs7530863 | 0.51 | 0.5160794 | 0.8778 |
| hCV32055474 | rs10864359 | hCV3087000 | rs1463055 | 0.51 | 0.5160794 | 0.8759 |
| hCV32055474 | rs10864359 | hCV3087003 | rs6577500 | 0.51 | 0.5160794 | 0.8759 |
| hCV32055474 | rs10864359 | hCV3087015 | rs11121198 | 0.51 | 0.5160794 | 0.8759 |
| hCV32055474 | rs10864359 | hCV3087016 | rs2297867 | 0.51 | 0.5160794 | 0.85 |
| hCV32055474 | rs10864359 | hCV32055284 | rs12079653 | 0.51 | 0.5160794 | 0.6676 |
| hCV32055474 | rs10864359 | hCV32055470 | rs6577506 | 0.51 | 0.5160794 | 0.9379 |
| hCV32055474 | rs10864359 | hCV32055477 | rs10779705 | 0.51 | 0.5160794 | 1 |
| hCV32055474 | rs10864359 | hCV32055527 | rs10864364 | 0.51 | 0.5160794 | 0.6717 |
| hCV32055474 | rs10864359 | hCV32055548 | rs11121197 | 0.51 | 0.5160794 | 0.8759 |
| hCV32055474 | rs10864359 | hCV32055579 | rs6577522 | 0.51 | 0.5160794 | 0.7977 |
| hCV32055474 | rs10864359 | hCV32055595 | rs6577524 | 0.51 | 0.5160794 | 0.7979 |
| hCV32055474 | rs10864359 | hCV32055596 | rs6577525 | 0.51 | 0.5160794 | 0.6717 |
| hCV32055474 | rs10864359 | hCV32055625 | rs6678590 | 0.51 | 0.5160794 | 0.7419 |
| hCV32055474 | rs10864359 | hCV32055637 | rs6577532 | 0.51 | 0.5160794 | 0.5364 |
| hCV32055474 | rs10864359 | hCV32055677 | rs10864355 | 0.51 | 0.5160794 | 0.8759 |
| hCV32055474 | rs10864359 | hCV529178 | rs301811 | 0.51 | 0.5160794 | 0.8759 |
| hCV32055474 | rs10864359 | hCV529182 | rs301800 | 0.51 | 0.5160794 | 0.5869 |
| hCV32055474 | rs10864359 | hCV597227 | rs301809 | 0.51 | 0.5160794 | 0.8759 |
| hCV32055474 | rs10864359 | hCV597229 | rs301785 | 0.51 | 0.5160794 | 0.8759 |
| hCV32055474 | rs10864359 | hCV877241 | rs301788 | 0.51 | 0.5160794 | 0.5606 |
| hCV32055474 | rs10864359 | hCV8823713 | rs1472228 | 0.51 | 0.5160794 | 0.6717 |
| hCV32055474 | rs10864359 | hCV8824288 | rs910582 | 0.51 | 0.5160794 | 0.8759 |
| hCV32055474 | rs10864359 | hCV8824394 | rs1443929 | 0.51 | 0.5160794 | 0.5606 |
| hCV32055474 | rs10864359 | hCV8824424 | rs1058790 | 0.51 | 0.5160794 | 0.6208 |
| hCV32055474 | rs10864359 | hCV8824425 | rs1058791 | 0.51 | 0.5160794 | 0.5324 |
| hCV32055474 | rs10864359 | hCV8881145 | rs1038008 | 0.51 | 0.5160794 | 1 |
| hCV32055474 | rs10864359 | hCV8881146 | rs1463054 | 0.51 | 0.5160794 | 1 |
| hCV32055474 | rs10864359 | hCV8881157 | rs1535158 | 0.51 | 0.5160794 | 1 |
| hCV32055474 | rs10864359 | hCV8881161 | rs926951 | 0.51 | 0.5160794 | 0.8778 |
| hCV32055477 | rs10779705 | hCV11398434 | rs1812457 | 0.51 | 0.519194102 | 1 |
| hCV32055477 | rs10779705 | hCV11398437 | rs1817367 | 0.51 | 0.519194102 | 1 |
| hCV32055477 | rs10779705 | hCV11675962 | rs10746481 | 0.51 | 0.519194102 | 0.9381 |
| hCV32055477 | rs10779705 | hCV1188731 | rs4908514 | 0.51 | 0.519194102 | 0.8094 |
| hCV32055477 | rs10779705 | hCV1188735 | rs10864366 | 0.51 | 0.519194102 | 0.7979 |
| hCV32055477 | rs10779705 | hCV15882429 | rs2289732 | 0.51 | 0.519194102 | 0.5975 |
| hCV32055477 | rs10779705 | hCV15932991 | rs2781067 | 0.51 | 0.519194102 | 0.5861 |
| hCV32055477 | rs10779705 | hCV27157507 | rs6664000 | 0.51 | 0.519194102 | 0.7979 |
| hCV32055477 | rs10779705 | hCV27157524 | rs6577531 | 0.51 | 0.519194102 | 0.7539 |
| hCV32055477 | rs10779705 | hCV2741759 | rs11121179 | 0.51 | 0.519194102 | 0.5747 |
| hCV32055477 | rs10779705 | hCV27884601 | rs4908776 | 0.51 | 0.519194102 | 0.8089 |
| hCV32055477 | rs10779705 | hCV27958354 | rs4908762 | 0.51 | 0.519194102 | 0.8759 |
| hCV32055477 | rs10779705 | hCV28023091 | rs4908773 | 0.51 | 0.519194102 | 0.7979 |
| hCV32055477 | rs10779705 | hCV29368919 | rs4908513 | 0.51 | 0.519194102 | 0.8094 |
| hCV32055477 | rs10779705 | hCV2943451 | rs902355 | 0.51 | 0.519194102 | 0.6736 |
| hCV32055477 | rs10779705 | hCV2943853 | rs301793 | 0.51 | 0.519194102 | 0.5975 |
| hCV32055477 | rs10779705 | hCV2966436 | rs11121174 | 0.51 | 0.519194102 | 0.5975 |
| hCV32055477 | rs10779705 | hCV2966437 | rs11580417 | 0.51 | 0.519194102 | 0.5975 |
| hCV32055477 | rs10779705 | hCV2966441 | rs6684863 | 0.51 | 0.519194102 | 0.5975 |
| hCV32055477 | rs10779705 | hCV2966444 | rs11121171 | 0.51 | 0.519194102 | 0.6417 |
| hCV32055477 | rs10779705 | hCV29819064 | rs6698079 | 0.51 | 0.519194102 | 1 |
| hCV32055477 | rs10779705 | hCV2987250 | rs301810 | 0.51 | 0.519194102 | 0.6812 |
| hCV32055477 | rs10779705 | hCV29873524 | rs7533113 | 0.51 | 0.519194102 | 0.8094 |
| hCV32055477 | rs10779705 | hCV29873526 | rs6697997 | 0.51 | 0.519194102 | 0.8824 |
| hCV32055477 | rs10779705 | hCV29945430 | rs7517436 | 0.51 | 0.519194102 | 0.7979 |
| hCV32055477 | rs10779705 | hCV30035535 | rs7518204 | 0.51 | 0.519194102 | 0.8087 |
| hCV32055477 | rs10779705 | hCV30125699 | rs4581300 | 0.51 | 0.519194102 | 0.8759 |
| hCV32055477 | rs10779705 | hCV30143725 | rs6690050 | 0.51 | 0.519194102 | 0.9381 |
| hCV32055477 | rs10779705 | hCV30467730 | rs6702457 | 0.51 | 0.519194102 | 0.9381 |
| hCV32055477 | rs10779705 | hCV3086930 | rs6658881 | 0.51 | 0.519194102 | 0.9345 |
| hCV32055477 | rs10779705 | hCV3086932 | rs7533442 | 0.51 | 0.519194102 | 0.9345 |
| hCV32055477 | rs10779705 | hCV3086950 | rs4908771 | 0.51 | 0.519194102 | 0.9381 |
| hCV32055477 | rs10779705 | hCV3086961 | rs6703577 | 0.51 | 0.519194102 | 1 |
| hCV32055477 | rs10779705 | hCV3086971 | rs6679948 | 0.51 | 0.519194102 | 1 |
| hCV32055477 | rs10779705 | hCV3086972 | rs6688329 | 0.51 | 0.519194102 | 1 |
| hCV32055477 | rs10779705 | hCV3086998 | rs7530863 | 0.51 | 0.519194102 | 0.8759 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV32055477 | rs10779705 | hCV3087000 | rs1463055 | 0.51 | 0.519194102 | 0.8824 |
| hCV32055477 | rs10779705 | hCV3087003 | rs6577500 | 0.51 | 0.519194102 | 0.8824 |
| hCV32055477 | rs10779705 | hCV3087015 | rs11121198 | 0.51 | 0.519194102 | 0.8824 |
| hCV32055477 | rs10779705 | hCV3087016 | rs2297867 | 0.51 | 0.519194102 | 0.8759 |
| hCV32055477 | rs10779705 | hCV32055284 | rs12079653 | 0.51 | 0.519194102 | 0.6858 |
| hCV32055477 | rs10779705 | hCV32055470 | rs6577506 | 0.51 | 0.519194102 | 1 |
| hCV32055477 | rs10779705 | hCV32055474 | rs10864359 | 0.51 | 0.519194102 | 1 |
| hCV32055477 | rs10779705 | hCV32055527 | rs10864364 | 0.51 | 0.519194102 | 0.7979 |
| hCV32055477 | rs10779705 | hCV32055548 | rs11121197 | 0.51 | 0.519194102 | 0.8824 |
| hCV32055477 | rs10779705 | hCV32055579 | rs6577522 | 0.51 | 0.519194102 | 0.8092 |
| hCV32055477 | rs10779705 | hCV32055595 | rs6577524 | 0.51 | 0.519194102 | 0.8094 |
| hCV32055477 | rs10779705 | hCV32055596 | rs6577525 | 0.51 | 0.519194102 | 0.7979 |
| hCV32055477 | rs10779705 | hCV32055625 | rs6678590 | 0.51 | 0.519194102 | 0.7684 |
| hCV32055477 | rs10779705 | hCV32055637 | rs6577532 | 0.51 | 0.519194102 | 0.7394 |
| hCV32055477 | rs10779705 | hCV32055662 | rs6677249 | 0.51 | 0.519194102 | 0.5758 |
| hCV32055477 | rs10779705 | hCV32055677 | rs10864355 | 0.51 | 0.519194102 | 0.8824 |
| hCV32055477 | rs10779705 | hCV529178 | rs301811 | 0.51 | 0.519194102 | 0.8824 |
| hCV32055477 | rs10779705 | hCV529182 | rs301800 | 0.51 | 0.519194102 | 0.6217 |
| hCV32055477 | rs10779705 | hCV597227 | rs301809 | 0.51 | 0.519194102 | 0.8824 |
| hCV32055477 | rs10779705 | hCV597229 | rs301785 | 0.51 | 0.519194102 | 0.8824 |
| hCV32055477 | rs10779705 | hCV877241 | rs301788 | 0.51 | 0.519194102 | 0.5747 |
| hCV32055477 | rs10779705 | hCV8823713 | rs1472228 | 0.51 | 0.519194102 | 0.7979 |
| hCV32055477 | rs10779705 | hCV8824288 | rs910582 | 0.51 | 0.519194102 | 0.8824 |
| hCV32055477 | rs10779705 | hCV8824394 | rs1443929 | 0.51 | 0.519194102 | 0.5747 |
| hCV32055477 | rs10779705 | hCV8824424 | rs1058790 | 0.51 | 0.519194102 | 0.6417 |
| hCV32055477 | rs10779705 | hCV8824425 | rs1058791 | 0.51 | 0.519194102 | 0.62 |
| hCV32055477 | rs10779705 | hCV8881145 | rs1038008 | 0.51 | 0.519194102 | 1 |
| hCV32055477 | rs10779705 | hCV8881146 | rs1463054 | 0.51 | 0.519194102 | 1 |
| hCV32055477 | rs10779705 | hCV8881157 | rs1535158 | 0.51 | 0.519194102 | 1 |
| hCV32055477 | rs10779705 | hCV8881161 | rs926951 | 0.51 | 0.519194102 | 0.8759 |
| hCV32055527 | rs10864364 | hCV11398434 | rs1812457 | 0.51 | 0.494565781 | 0.7979 |
| hCV32055527 | rs10864364 | hCV11398437 | rs1817367 | 0.51 | 0.494565781 | 0.6548 |
| hCV32055527 | rs10864364 | hCV11675962 | rs10746481 | 0.51 | 0.494565781 | 0.8704 |
| hCV32055527 | rs10864364 | hCV1188659 | rs3820037 | 0.51 | 0.494565781 | 0.5447 |
| hCV32055527 | rs10864364 | hCV1188660 | rs6660137 | 0.51 | 0.494565781 | 0.5538 |
| hCV32055527 | rs10864364 | hCV1188664 | rs2765511 | 0.51 | 0.494565781 | 0.6126 |
| hCV32055527 | rs10864364 | hCV1188665 | rs2781060 | 0.51 | 0.494565781 | 0.6354 |
| hCV32055527 | rs10864364 | hCV1188676 | rs11121247 | 0.51 | 0.494565781 | 0.5538 |
| hCV32055527 | rs10864364 | hCV1188731 | rs4908514 | 0.51 | 0.494565781 | 1 |
| hCV32055527 | rs10864364 | hCV1188735 | rs10864366 | 0.51 | 0.494565781 | 1 |
| hCV32055527 | rs10864364 | hCV12040675 | rs2038904 | 0.51 | 0.494565781 | 0.6126 |
| hCV32055527 | rs10864364 | hCV15882429 | rs2289732 | 0.51 | 0.494565781 | 0.6247 |
| hCV32055527 | rs10864364 | hCV15932991 | rs2781067 | 0.51 | 0.494565781 | 0.6188 |
| hCV32055527 | rs10864364 | hCV15932992 | rs2781068 | 0.51 | 0.494565781 | 0.6121 |
| hCV32055527 | rs10864364 | hCV27157507 | rs6664000 | 0.51 | 0.494565781 | 1 |
| hCV32055527 | rs10864364 | hCV27157524 | rs6577531 | 0.51 | 0.494565781 | 0.9314 |
| hCV32055527 | rs10864364 | hCV2741759 | rs11121179 | 0.51 | 0.494565781 | 0.6713 |
| hCV32055527 | rs10864364 | hCV27474399 | rs3753275 | 0.51 | 0.494565781 | 0.5807 |
| hCV32055527 | rs10864364 | hCV27884601 | rs4908776 | 0.51 | 0.494565781 | 1 |
| hCV32055527 | rs10864364 | hCV27958354 | rs4908762 | 0.51 | 0.494565781 | 0.6717 |
| hCV32055527 | rs10864364 | hCV28023091 | rs4908773 | 0.51 | 0.494565781 | 1 |
| hCV32055527 | rs10864364 | hCV29368919 | rs4908513 | 0.51 | 0.494565781 | 1 |
| hCV32055527 | rs10864364 | hCV2943451 | rs902355 | 0.51 | 0.494565781 | 0.7098 |
| hCV32055527 | rs10864364 | hCV2943853 | rs301793 | 0.51 | 0.494565781 | 0.6247 |
| hCV32055527 | rs10864364 | hCV2966436 | rs11121174 | 0.51 | 0.494565781 | 0.6247 |
| hCV32055527 | rs10864364 | hCV2966437 | rs11580417 | 0.51 | 0.494565781 | 0.6247 |
| hCV32055527 | rs10864364 | hCV2966441 | rs6684863 | 0.51 | 0.494565781 | 0.6247 |
| hCV32055527 | rs10864364 | hCV2966444 | rs11121171 | 0.51 | 0.494565781 | 0.6727 |
| hCV32055527 | rs10864364 | hCV29819064 | rs6698079 | 0.51 | 0.494565781 | 0.7458 |
| hCV32055527 | rs10864364 | hCV2987250 | rs301810 | 0.51 | 0.494565781 | 0.5105 |
| hCV32055527 | rs10864364 | hCV29873524 | rs7533113 | 0.51 | 0.494565781 | 1 |
| hCV32055527 | rs10864364 | hCV29873526 | rs6697997 | 0.51 | 0.494565781 | 0.6952 |
| hCV32055527 | rs10864364 | hCV29945430 | rs7517436 | 0.51 | 0.494565781 | 1 |
| hCV32055527 | rs10864364 | hCV30035535 | rs7518204 | 0.51 | 0.494565781 | 1 |
| hCV32055527 | rs10864364 | hCV30125699 | rs4581300 | 0.51 | 0.494565781 | 0.6067 |
| hCV32055527 | rs10864364 | hCV30143725 | rs6690050 | 0.51 | 0.494565781 | 0.7437 |
| hCV32055527 | rs10864364 | hCV30467730 | rs6702457 | 0.51 | 0.494565781 | 0.8704 |
| hCV32055527 | rs10864364 | hCV3086930 | rs6658881 | 0.51 | 0.494565781 | 0.8213 |
| hCV32055527 | rs10864364 | hCV3086932 | rs7533442 | 0.51 | 0.494565781 | 0.8213 |
| hCV32055527 | rs10864364 | hCV3086950 | rs4908771 | 0.51 | 0.494565781 | 0.8704 |
| hCV32055527 | rs10864364 | hCV3086961 | rs6703577 | 0.51 | 0.494565781 | 0.7188 |
| hCV32055527 | rs10864364 | hCV3086971 | rs6679948 | 0.51 | 0.494565781 | 0.7979 |
| hCV32055527 | rs10864364 | hCV3086972 | rs6688329 | 0.51 | 0.494565781 | 0.8568 |
| hCV32055527 | rs10864364 | hCV3086998 | rs7530863 | 0.51 | 0.494565781 | 0.6717 |
| hCV32055527 | rs10864364 | hCV3087000 | rs1463055 | 0.51 | 0.494565781 | 0.6952 |
| hCV32055527 | rs10864364 | hCV3087003 | rs6577500 | 0.51 | 0.494565781 | 0.6952 |
| hCV32055527 | rs10864364 | hCV3087015 | rs11121198 | 0.51 | 0.494565781 | 0.6952 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV32055527 | rs10864364 | hCV3087016 | rs2297867 | 0.51 | 0.494565781 | 0.6499 |
| hCV32055527 | rs10864364 | hCV32055284 | rs12079653 | 0.51 | 0.494565781 | 0.6676 |
| hCV32055527 | rs10864364 | hCV32055470 | rs6577506 | 0.51 | 0.494565781 | 0.7188 |
| hCV32055527 | rs10864364 | hCV32055474 | rs10864359 | 0.51 | 0.494565781 | 0.6717 |
| hCV32055527 | rs10864364 | hCV32055477 | rs10779705 | 0.51 | 0.494565781 | 0.7979 |
| hCV32055527 | rs10864364 | hCV32055548 | rs11121197 | 0.51 | 0.494565781 | 0.6952 |
| hCV32055527 | rs10864364 | hCV32055579 | rs6577522 | 0.51 | 0.494565781 | 1 |
| hCV32055527 | rs10864364 | hCV32055595 | rs6577524 | 0.51 | 0.494565781 | 1 |
| hCV32055527 | rs10864364 | hCV32055596 | rs6577525 | 0.51 | 0.494565781 | 1 |
| hCV32055527 | rs10864364 | hCV32055625 | rs6678590 | 0.51 | 0.494565781 | 0.8645 |
| hCV32055527 | rs10864364 | hCV32055637 | rs6577532 | 0.51 | 0.494565781 | 0.8301 |
| hCV32055527 | rs10864364 | hCV32055662 | rs6677249 | 0.51 | 0.494565781 | 0.645 |
| hCV32055527 | rs10864364 | hCV32055677 | rs10864355 | 0.51 | 0.494565781 | 0.6952 |
| hCV32055527 | rs10864364 | hCV529178 | rs301811 | 0.51 | 0.494565781 | 0.6949 |
| hCV32055527 | rs10864364 | hCV529182 | rs301800 | 0.51 | 0.494565781 | 0.6998 |
| hCV32055527 | rs10864364 | hCV597227 | rs301809 | 0.51 | 0.494565781 | 0.6952 |
| hCV32055527 | rs10864364 | hCV597229 | rs301785 | 0.51 | 0.494565781 | 0.6952 |
| hCV32055527 | rs10864364 | hCV877241 | rs301788 | 0.51 | 0.494565781 | 0.6713 |
| hCV32055527 | rs10864364 | hCV8823713 | rs1472228 | 0.51 | 0.494565781 | 1 |
| hCV32055527 | rs10864364 | hCV8824244 | rs1006950 | 0.51 | 0.494565781 | 0.574 |
| hCV32055527 | rs10864364 | hCV8824248 | rs1543711 | 0.51 | 0.494565781 | 0.6126 |
| hCV32055527 | rs10864364 | hCV8824288 | rs910582 | 0.51 | 0.494565781 | 0.6952 |
| hCV32055527 | rs10864364 | hCV8824394 | rs1443929 | 0.51 | 0.494565781 | 0.6713 |
| hCV32055527 | rs10864364 | hCV8824424 | rs1058790 | 0.51 | 0.494565781 | 0.6727 |
| hCV32055527 | rs10864364 | hCV8824425 | rs1058791 | 0.51 | 0.494565781 | 0.6383 |
| hCV32055527 | rs10864364 | hCV8881145 | rs1038008 | 0.51 | 0.494565781 | 0.7979 |
| hCV32055527 | rs10864364 | hCV8881146 | rs1463054 | 0.51 | 0.494565781 | 0.8032 |
| hCV32055527 | rs10864364 | hCV8881157 | rs1535158 | 0.51 | 0.494565781 | 0.7979 |
| hCV32055527 | rs10864364 | hCV8881161 | rs926951 | 0.51 | 0.494565781 | 0.6717 |
| hCV32055595 | rs6577524 | hCV11398434 | rs1812457 | 0.51 | 0.496166123 | 0.8094 |
| hCV32055595 | rs6577524 | hCV11398437 | rs1817367 | 0.51 | 0.496166123 | 0.7755 |
| hCV32055595 | rs6577524 | hCV11675962 | rs10746481 | 0.51 | 0.496166123 | 0.8774 |
| hCV32055595 | rs6577524 | hCV1188659 | rs3820037 | 0.51 | 0.496166123 | 0.5968 |
| hCV32055595 | rs6577524 | hCV1188660 | rs6660137 | 0.51 | 0.496166123 | 0.6126 |
| hCV32055595 | rs6577524 | hCV1188664 | rs2765511 | 0.51 | 0.496166123 | 0.6312 |
| hCV32055595 | rs6577524 | hCV1188665 | rs2781060 | 0.51 | 0.496166123 | 0.6541 |
| hCV32055595 | rs6577524 | hCV1188676 | rs11121247 | 0.51 | 0.496166123 | 0.6126 |
| hCV32055595 | rs6577524 | hCV1188731 | rs4908514 | 0.51 | 0.496166123 | 1 |
| hCV32055595 | rs6577524 | hCV1188735 | rs10864366 | 0.51 | 0.496166123 | 1 |
| hCV32055595 | rs6577524 | hCV12040675 | rs2038904 | 0.51 | 0.496166123 | 0.6312 |
| hCV32055595 | rs6577524 | hCV15882429 | rs2289732 | 0.51 | 0.496166123 | 0.6452 |
| hCV32055595 | rs6577524 | hCV15932991 | rs2781067 | 0.51 | 0.496166123 | 0.6396 |
| hCV32055595 | rs6577524 | hCV15932992 | rs2781068 | 0.51 | 0.496166123 | 0.6308 |
| hCV32055595 | rs6577524 | hCV27157507 | rs6664000 | 0.51 | 0.496166123 | 1 |
| hCV32055595 | rs6577524 | hCV27157524 | rs6577531 | 0.51 | 0.496166123 | 0.9353 |
| hCV32055595 | rs6577524 | hCV27157546 | rs11811795 | 0.51 | 0.496166123 | 0.5453 |
| hCV32055595 | rs6577524 | hCV27157560 | rs11121252 | 0.51 | 0.496166123 | 0.5135 |
| hCV32055595 | rs6577524 | hCV2741759 | rs11121179 | 0.51 | 0.496166123 | 0.6247 |
| hCV32055595 | rs6577524 | hCV27884601 | rs4908776 | 0.51 | 0.496166123 | 1 |
| hCV32055595 | rs6577524 | hCV27958354 | rs4908762 | 0.51 | 0.496166123 | 0.6952 |
| hCV32055595 | rs6577524 | hCV28023091 | rs4908773 | 0.51 | 0.496166123 | 1 |
| hCV32055595 | rs6577524 | hCV29368919 | rs4908513 | 0.51 | 0.496166123 | 1 |
| hCV32055595 | rs6577524 | hCV2943451 | rs902355 | 0.51 | 0.496166123 | 0.7273 |
| hCV32055595 | rs6577524 | hCV2943853 | rs301793 | 0.51 | 0.496166123 | 0.6452 |
| hCV32055595 | rs6577524 | hCV2966436 | rs11121174 | 0.51 | 0.496166123 | 0.6452 |
| hCV32055595 | rs6577524 | hCV2966437 | rs11580417 | 0.51 | 0.496166123 | 0.6452 |
| hCV32055595 | rs6577524 | hCV2966441 | rs6684863 | 0.51 | 0.496166123 | 0.6452 |
| hCV32055595 | rs6577524 | hCV2966444 | rs11121171 | 0.51 | 0.496166123 | 0.6911 |
| hCV32055595 | rs6577524 | hCV29819064 | rs6698079 | 0.51 | 0.496166123 | 0.7479 |
| hCV32055595 | rs6577524 | hCV2987250 | rs301810 | 0.51 | 0.496166123 | 0.6312 |
| hCV32055595 | rs6577524 | hCV29873524 | rs7533113 | 0.51 | 0.496166123 | 1 |
| hCV32055595 | rs6577524 | hCV29873526 | rs6697997 | 0.51 | 0.496166123 | 0.7112 |
| hCV32055595 | rs6577524 | hCV29945430 | rs7517436 | 0.51 | 0.496166123 | 1 |
| hCV32055595 | rs6577524 | hCV30035535 | rs7518204 | 0.51 | 0.496166123 | 1 |
| hCV32055595 | rs6577524 | hCV30125699 | rs4581300 | 0.51 | 0.496166123 | 0.6952 |
| hCV32055595 | rs6577524 | hCV30143725 | rs6690050 | 0.51 | 0.496166123 | 0.7577 |
| hCV32055595 | rs6577524 | hCV30467730 | rs6702457 | 0.51 | 0.496166123 | 0.8774 |
| hCV32055595 | rs6577524 | hCV3086930 | rs6658881 | 0.51 | 0.496166123 | 0.8704 |
| hCV32055595 | rs6577524 | hCV3086932 | rs7533442 | 0.51 | 0.496166123 | 0.8704 |
| hCV32055595 | rs6577524 | hCV3086950 | rs4908771 | 0.51 | 0.496166123 | 0.8774 |
| hCV32055595 | rs6577524 | hCV3086961 | rs6703577 | 0.51 | 0.496166123 | 0.7979 |
| hCV32055595 | rs6577524 | hCV3086971 | rs6679948 | 0.51 | 0.496166123 | 0.8094 |
| hCV32055595 | rs6577524 | hCV3086972 | rs6688329 | 0.51 | 0.496166123 | 0.8654 |
| hCV32055595 | rs6577524 | hCV3086998 | rs7530863 | 0.51 | 0.496166123 | 0.6952 |
| hCV32055595 | rs6577524 | hCV3087000 | rs1463055 | 0.51 | 0.496166123 | 0.7112 |
| hCV32055595 | rs6577524 | hCV3087003 | rs6577500 | 0.51 | 0.496166123 | 0.7112 |
| hCV32055595 | rs6577524 | hCV3087015 | rs11121198 | 0.51 | 0.496166123 | 0.7112 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV32055595 | rs6577524 | hCV3087016 | rs2297867 | 0.51 | 0.496166123 | 0.6952 |
| hCV32055595 | rs6577524 | hCV32055284 | rs12079653 | 0.51 | 0.496166123 | 0.6858 |
| hCV32055595 | rs6577524 | hCV32055470 | rs6577506 | 0.51 | 0.496166123 | 0.7979 |
| hCV32055595 | rs6577524 | hCV32055474 | rs10864359 | 0.51 | 0.496166123 | 0.7979 |
| hCV32055595 | rs6577524 | hCV32055477 | rs10779705 | 0.51 | 0.496166123 | 0.8094 |
| hCV32055595 | rs6577524 | hCV32055527 | rs10864364 | 0.51 | 0.496166123 | 1 |
| hCV32055595 | rs6577524 | hCV32055548 | rs11121197 | 0.51 | 0.496166123 | 0.7112 |
| hCV32055595 | rs6577524 | hCV32055579 | rs6577522 | 0.51 | 0.496166123 | 1 |
| hCV32055595 | rs6577524 | hCV32055596 | rs6577525 | 0.51 | 0.496166123 | 1 |
| hCV32055595 | rs6577524 | hCV32055625 | rs6678590 | 0.51 | 0.496166123 | 0.879 |
| hCV32055595 | rs6577524 | hCV32055637 | rs6577532 | 0.51 | 0.496166123 | 0.9314 |
| hCV32055595 | rs6577524 | hCV32055662 | rs6677249 | 0.51 | 0.496166123 | 0.7437 |
| hCV32055595 | rs6577524 | hCV32055677 | rs10864355 | 0.51 | 0.496166123 | 0.7112 |
| hCV32055595 | rs6577524 | hCV529178 | rs301811 | 0.51 | 0.496166123 | 0.7109 |
| hCV32055595 | rs6577524 | hCV529182 | rs301800 | 0.51 | 0.496166123 | 0.6732 |
| hCV32055595 | rs6577524 | hCV597227 | rs301809 | 0.51 | 0.496166123 | 0.7112 |
| hCV32055595 | rs6577524 | hCV597229 | rs301785 | 0.51 | 0.496166123 | 0.7112 |
| hCV32055595 | rs6577524 | hCV877241 | rs301788 | 0.51 | 0.496166123 | 0.6247 |
| hCV32055595 | rs6577524 | hCV8823713 | rs1472228 | 0.51 | 0.496166123 | 1 |
| hCV32055595 | rs6577524 | hCV8824241 | rs1325920 | 0.51 | 0.496166123 | 0.5423 |
| hCV32055595 | rs6577524 | hCV8824244 | rs1006950 | 0.51 | 0.496166123 | 0.6126 |
| hCV32055595 | rs6577524 | hCV8824248 | rs1543711 | 0.51 | 0.496166123 | 0.6312 |
| hCV32055595 | rs6577524 | hCV8824288 | rs910582 | 0.51 | 0.496166123 | 0.7112 |
| hCV32055595 | rs6577524 | hCV8824394 | rs1443929 | 0.51 | 0.496166123 | 0.6247 |
| hCV32055595 | rs6577524 | hCV8824424 | rs1058790 | 0.51 | 0.496166123 | 0.6911 |
| hCV32055595 | rs6577524 | hCV8824425 | rs1058791 | 0.51 | 0.496166123 | 0.6721 |
| hCV32055595 | rs6577524 | hCV8881145 | rs1038008 | 0.51 | 0.496166123 | 0.8094 |
| hCV32055595 | rs6577524 | hCV8881146 | rs1463054 | 0.51 | 0.496166123 | 0.8042 |
| hCV32055595 | rs6577524 | hCV8881157 | rs1535158 | 0.51 | 0.496166123 | 0.8094 |
| hCV32055595 | rs6577524 | hCV8881161 | rs926951 | 0.51 | 0.496166123 | 0.6952 |
| hCV32055596 | rs6577525 | hCV11675962 | rs10746481 | 0.51 | 0.868658647 | 0.8704 |
| hCV32055596 | rs6577525 | hCV1188731 | rs4908514 | 0.51 | 0.868658647 | 1 |
| hCV32055596 | rs6577525 | hCV1188735 | rs10864366 | 0.51 | 0.868658647 | 1 |
| hCV32055596 | rs6577525 | hCV27157507 | rs6664000 | 0.51 | 0.868658647 | 1 |
| hCV32055596 | rs6577525 | hCV27157524 | rs6577531 | 0.51 | 0.868658647 | 0.9314 |
| hCV32055596 | rs6577525 | hCV27884601 | rs4908776 | 0.51 | 0.868658647 | 1 |
| hCV32055596 | rs6577525 | hCV28023091 | rs4908773 | 0.51 | 0.868658647 | 1 |
| hCV32055596 | rs6577525 | hCV29368919 | rs4908513 | 0.51 | 0.868658647 | 1 |
| hCV32055596 | rs6577525 | hCV29873524 | rs7533113 | 0.51 | 0.868658647 | 1 |
| hCV32055596 | rs6577525 | hCV29945430 | rs7517436 | 0.51 | 0.868658647 | 1 |
| hCV32055596 | rs6577525 | hCV30035535 | rs7518204 | 0.51 | 0.868658647 | 1 |
| hCV32055596 | rs6577525 | hCV30467730 | rs6702457 | 0.51 | 0.868658647 | 0.8704 |
| hCV32055596 | rs6577525 | hCV3086950 | rs4908771 | 0.51 | 0.868658647 | 0.8704 |
| hCV32055596 | rs6577525 | hCV32055527 | rs10864364 | 0.51 | 0.868658647 | 1 |
| hCV32055596 | rs6577525 | hCV32055579 | rs6577522 | 0.51 | 0.868658647 | 1 |
| hCV32055596 | rs6577525 | hCV32055595 | rs6577524 | 0.51 | 0.868658647 | 1 |
| hCV32055596 | rs6577525 | hCV8823713 | rs1472228 | 0.51 | 0.868658647 | 1 |
| hCV32055625 | rs6678590 | hCV11398434 | rs1812457 | 0.51 | 0.498774246 | 0.7684 |
| hCV32055625 | rs6678590 | hCV11398437 | rs1817367 | 0.51 | 0.498774246 | 0.7419 |
| hCV32055625 | rs6678590 | hCV11675962 | rs10746481 | 0.51 | 0.498774246 | 0.7684 |
| hCV32055625 | rs6678590 | hCV1188659 | rs3820037 | 0.51 | 0.498774246 | 0.6049 |
| hCV32055625 | rs6678590 | hCV1188660 | rs6660137 | 0.51 | 0.498774246 | 0.6341 |
| hCV32055625 | rs6678590 | hCV1188664 | rs2765511 | 0.51 | 0.498774246 | 0.6612 |
| hCV32055625 | rs6678590 | hCV1188665 | rs2781060 | 0.51 | 0.498774246 | 0.7019 |
| hCV32055625 | rs6678590 | hCV1188676 | rs11121247 | 0.51 | 0.498774246 | 0.6341 |
| hCV32055625 | rs6678590 | hCV1188731 | rs4908514 | 0.51 | 0.498774246 | 0.879 |
| hCV32055625 | rs6678590 | hCV1188735 | rs10864366 | 0.51 | 0.498774246 | 0.8645 |
| hCV32055625 | rs6678590 | hCV12040675 | rs2038904 | 0.51 | 0.498774246 | 0.6612 |
| hCV32055625 | rs6678590 | hCV15882429 | rs2289732 | 0.51 | 0.498774246 | 0.6066 |
| hCV32055625 | rs6678590 | hCV15932991 | rs2781067 | 0.51 | 0.498774246 | 0.7025 |
| hCV32055625 | rs6678590 | hCV15932992 | rs2781068 | 0.51 | 0.498774246 | 0.6612 |
| hCV32055625 | rs6678590 | hCV27157507 | rs6664000 | 0.51 | 0.498774246 | 0.8645 |
| hCV32055625 | rs6678590 | hCV27157524 | rs6577531 | 0.51 | 0.498774246 | 1 |
| hCV32055625 | rs6678590 | hCV27157546 | rs11811795 | 0.51 | 0.498774246 | 0.6341 |
| hCV32055625 | rs6678590 | hCV2741759 | rs11121179 | 0.51 | 0.498774246 | 0.5689 |
| hCV32055625 | rs6678590 | hCV27884601 | rs4908776 | 0.51 | 0.498774246 | 0.8788 |
| hCV32055625 | rs6678590 | hCV27958354 | rs4908762 | 0.51 | 0.498774246 | 0.57 |
| hCV32055625 | rs6678590 | hCV28023091 | rs4908773 | 0.51 | 0.498774246 | 0.8645 |
| hCV32055625 | rs6678590 | hCV29368919 | rs4908513 | 0.51 | 0.498774246 | 0.879 |
| hCV32055625 | rs6678590 | hCV2943451 | rs902355 | 0.51 | 0.498774246 | 0.7115 |
| hCV32055625 | rs6678590 | hCV2943853 | rs301793 | 0.51 | 0.498774246 | 0.6066 |
| hCV32055625 | rs6678590 | hCV2966436 | rs11121174 | 0.51 | 0.498774246 | 0.6066 |
| hCV32055625 | rs6678590 | hCV2966437 | rs11580417 | 0.51 | 0.498774246 | 0.6066 |
| hCV32055625 | rs6678590 | hCV2966441 | rs6684863 | 0.51 | 0.498774246 | 0.6066 |
| hCV32055625 | rs6678590 | hCV2966444 | rs11121171 | 0.51 | 0.498774246 | 0.6793 |
| hCV32055625 | rs6678590 | hCV29819064 | rs6698079 | 0.51 | 0.498774246 | 0.7125 |
| hCV32055625 | rs6678590 | hCV29873524 | rs7533113 | 0.51 | 0.498774246 | 0.879 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV32055625 | rs6678590 | hCV29873526 | rs6697997 | 0.51 | 0.498774246 | 0.6074 |
| hCV32055625 | rs6678590 | hCV29945430 | rs7517436 | 0.51 | 0.498774246 | 0.8645 |
| hCV32055625 | rs6678590 | hCV30035535 | rs7518204 | 0.51 | 0.498774246 | 1 |
| hCV32055625 | rs6678590 | hCV30125699 | rs4581300 | 0.51 | 0.498774246 | 0.57 |
| hCV32055625 | rs6678590 | hCV30143725 | rs6690050 | 0.51 | 0.498774246 | 0.6799 |
| hCV32055625 | rs6678590 | hCV30467730 | rs6702457 | 0.51 | 0.498774246 | 0.7684 |
| hCV32055625 | rs6678590 | hCV3086930 | rs6658881 | 0.51 | 0.498774246 | 0.7419 |
| hCV32055625 | rs6678590 | hCV3086932 | rs7533442 | 0.51 | 0.498774246 | 0.7419 |
| hCV32055625 | rs6678590 | hCV3086950 | rs4908771 | 0.51 | 0.498774246 | 0.7684 |
| hCV32055625 | rs6678590 | hCV3086961 | rs6703577 | 0.51 | 0.498774246 | 0.7419 |
| hCV32055625 | rs6678590 | hCV3086971 | rs6679948 | 0.51 | 0.498774246 | 0.7684 |
| hCV32055625 | rs6678590 | hCV3086972 | rs6688329 | 0.51 | 0.498774246 | 0.878 |
| hCV32055625 | rs6678590 | hCV3086998 | rs7530863 | 0.51 | 0.498774246 | 0.57 |
| hCV32055625 | rs6678590 | hCV3087000 | rs1463055 | 0.51 | 0.498774246 | 0.6074 |
| hCV32055625 | rs6678590 | hCV3087003 | rs6577500 | 0.51 | 0.498774246 | 0.6074 |
| hCV32055625 | rs6678590 | hCV3087015 | rs11121198 | 0.51 | 0.498774246 | 0.6074 |
| hCV32055625 | rs6678590 | hCV3087016 | rs2297867 | 0.51 | 0.498774246 | 0.57 |
| hCV32055625 | rs6678590 | hCV32055284 | rs12079653 | 0.51 | 0.498774246 | 0.6752 |
| hCV32055625 | rs6678590 | hCV32055470 | rs6577506 | 0.51 | 0.498774246 | 0.7419 |
| hCV32055625 | rs6678590 | hCV32055474 | rs10864359 | 0.51 | 0.498774246 | 0.7419 |
| hCV32055625 | rs6678590 | hCV32055477 | rs10779705 | 0.51 | 0.498774246 | 0.7684 |
| hCV32055625 | rs6678590 | hCV32055527 | rs10864364 | 0.51 | 0.498774246 | 0.8645 |
| hCV32055625 | rs6678590 | hCV32055548 | rs11121197 | 0.51 | 0.498774246 | 0.6074 |
| hCV32055625 | rs6678590 | hCV32055579 | rs6577522 | 0.51 | 0.498774246 | 0.879 |
| hCV32055625 | rs6678590 | hCV32055595 | rs6577524 | 0.51 | 0.498774246 | 0.879 |
| hCV32055625 | rs6678590 | hCV32055596 | rs6577525 | 0.51 | 0.498774246 | 0.8645 |
| hCV32055625 | rs6678590 | hCV32055637 | rs6577532 | 0.51 | 0.498774246 | 1 |
| hCV32055625 | rs6678590 | hCV32055662 | rs6677249 | 0.51 | 0.498774246 | 0.878 |
| hCV32055625 | rs6678590 | hCV32055677 | rs10864355 | 0.51 | 0.498774246 | 0.6074 |
| hCV32055625 | rs6678590 | hCV529178 | rs301811 | 0.51 | 0.498774246 | 0.6074 |
| hCV32055625 | rs6678590 | hCV597227 | rs301809 | 0.51 | 0.498774246 | 0.6074 |
| hCV32055625 | rs6678590 | hCV597229 | rs301785 | 0.51 | 0.498774246 | 0.6074 |
| hCV32055625 | rs6678590 | hCV877241 | rs301788 | 0.51 | 0.498774246 | 0.5689 |
| hCV32055625 | rs6678590 | hCV8823713 | rs1472228 | 0.51 | 0.498774246 | 0.8645 |
| hCV32055625 | rs6678590 | hCV8824241 | rs1325920 | 0.51 | 0.498774246 | 0.6325 |
| hCV32055625 | rs6678590 | hCV8824244 | rs1006950 | 0.51 | 0.498774246 | 0.6341 |
| hCV32055625 | rs6678590 | hCV8824248 | rs1543711 | 0.51 | 0.498774246 | 0.6612 |
| hCV32055625 | rs6678590 | hCV8824288 | rs910582 | 0.51 | 0.498774246 | 0.6074 |
| hCV32055625 | rs6678590 | hCV8824394 | rs1443929 | 0.51 | 0.498774246 | 0.5689 |
| hCV32055625 | rs6678590 | hCV8824424 | rs1058790 | 0.51 | 0.498774246 | 0.6793 |
| hCV32055625 | rs6678590 | hCV8824425 | rs1058791 | 0.51 | 0.498774246 | 0.6456 |
| hCV32055625 | rs6678590 | hCV8881145 | rs1038008 | 0.51 | 0.498774246 | 0.7684 |
| hCV32055625 | rs6678590 | hCV8881146 | rs1463054 | 0.51 | 0.498774246 | 0.8464 |
| hCV32055625 | rs6678590 | hCV8881157 | rs1535158 | 0.51 | 0.498774246 | 0.7684 |
| hCV32055625 | rs6678590 | hCV8881161 | rs926951 | 0.51 | 0.498774246 | 0.57 |
| hCV32055654 | rs12135416 | hCV32055643 | rs12124851 | 0.51 | 0.639996897 | 0.8946 |
| hCV32055654 | rs12135416 | hCV32055656 | rs6673587 | 0.51 | 0.639996897 | 1 |
| hCV32055654 | rs12135416 | hCV8824265 | rs914994 | 0.51 | 0.639996897 | 0.9156 |
| hCV3215409 | rs267561 | hCV1025364 | rs743395 | 0.51 | 0.9 | 0.902 |
| hCV3215409 | rs267561 | hCV1025368 | rs182069 | 0.51 | 0.9 | 1 |
| hCV3215409 | rs267561 | hCV1025374 | rs267559 | 0.51 | 0.9 | 0.9643 |
| hCV3215409 | rs267561 | hCV1025375 | rs267564 | 0.51 | 0.9 | 1 |
| hCV3215409 | rs267561 | hCV1025379 | rs525731 | 0.51 | 0.9 | 1 |
| hCV3215409 | rs267561 | hCV1025384 | rs155525 | 0.51 | 0.9 | 0.966 |
| hCV3215409 | rs267561 | hCV1025386 | rs199263 | 0.51 | 0.9 | 0.9637 |
| hCV3215409 | rs267561 | hCV2924998 | rs1965078 | 0.51 | 0.9 | 0.9634 |
| hCV3215409 | rs267561 | hCV3215385 | rs3016003 | 0.51 | 0.9 | 0.9637 |
| hCV3215409 | rs267561 | hCV3215386 | rs267538 | 0.51 | 0.9 | 1 |
| hCV3215409 | rs267561 | hCV3215387 | rs267540 | 0.51 | 0.9 | 0.9649 |
| hCV3215409 | rs267561 | hCV3215388 | rs169146 | 0.51 | 0.9 | 1 |
| hCV3215409 | rs267561 | hCV3215391 | rs267543 | 0.51 | 0.9 | 1 |
| hCV3215409 | rs267561 | hCV3215394 | rs267546 | 0.51 | 0.9 | 0.9666 |
| hCV3215409 | rs267561 | hCV3215399 | rs267549 | 0.51 | 0.9 | 1 |
| hCV3215409 | rs267561 | hCV3215402 | rs267554 | 0.51 | 0.9 | 1 |
| hCV3215409 | rs267561 | hCV3215404 | rs267556 | 0.51 | 0.9 | 1 |
| hCV3215409 | rs267561 | hCV3215405 | rs182070 | 0.51 | 0.9 | 1 |
| hCV3215409 | rs267561 | hCV3215407 | rs267558 | 0.51 | 0.9 | 1 |
| hCV3215409 | rs267561 | hCV3215408 | rs267560 | 0.51 | 0.9 | 1 |
| hCV3215409 | rs267561 | hCV3215412 | rs267565 | 0.51 | 0.9 | 1 |
| hCV3215409 | rs267561 | hCV3215413 | rs267566 | 0.51 | 0.9 | 1 |
| hCV3215409 | rs267561 | hCV3215415 | rs559715 | 0.51 | 0.9 | 1 |
| hCV3215409 | rs267561 | hCV3215419 | rs155524 | 0.51 | 0.9 | 0.9637 |
| hCV3215409 | rs267561 | hCV3215421 | rs155522 | 0.51 | 0.9 | 1 |
| hCV3215409 | rs267561 | hCV3215422 | rs155521 | 0.51 | 0.9 | 0.9627 |
| hCV3215409 | rs267561 | hCV3215424 | rs553279 | 0.51 | 0.9 | 0.9634 |
| hCV3215409 | rs267561 | hCV3215426 | rs267515 | 0.51 | 0.9 | 0.9337 |
| hCV3215409 | rs267561 | hCV3215429 | rs267518 | 0.51 | 0.9 | 0.9326 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV3215409 | rs267561 | hCV3215430 | rs267521 | 0.51 | 0.9 | 0.9326 |
| hCV3215409 | rs267561 | hCV3215431 | rs267522 | 0.51 | 0.9 | 0.9326 |
| hCV3242952 | rs2000571 | hCV12086640 | rs12802944 | 0.51 | 0.9 | 0.9442 |
| hCV3242952 | rs2000571 | hCV16217099 | rs2367970 | 0.51 | 0.9 | 1 |
| hCV3242952 | rs2000571 | hCV26488196 | rs2008915 | 0.51 | 0.9 | 0.9314 |
| hCV3242952 | rs2000571 | hCV31254790 | rs11216109 | 0.51 | 0.9 | 1 |
| hCV3242952 | rs2000571 | hCV3242945 | rs10892020 | 0.51 | 0.9 | 0.9167 |
| hCV3242952 | rs2000571 | hCV3242955 | rs6589562 | 0.51 | 0.9 | 1 |
| hCV3242952 | rs2000571 | hCV3242972 | rs4938300 | 0.51 | 0.9 | 0.9314 |
| hCV3275199 | rs2069885 | hCV15860203 | rs2069884 | 0.51 | 0.9 | 1 |
| hCV341736 | rs11653589 | hCV16192346 | rs2316758 | 0.51 | 0.77061721 | 1 |
| hCV341736 | rs11653589 | hCV2592673 | rs4968286 | 0.51 | 0.77061721 | 0.788 |
| hCV341736 | rs11653589 | hCV2592715 | rs3851792 | 0.51 | 0.77061721 | 1 |
| hCV341736 | rs11653589 | hCV26660327 | rs11869840 | 0.51 | 0.77061721 | 0.788 |
| hCV341736 | rs11653589 | hCV27899058 | rs4074249 | 0.51 | 0.77061721 | 0.8511 |
| hCV341736 | rs11653589 | hCV29195255 | rs8068715 | 0.51 | 0.77061721 | 1 |
| hCV341736 | rs11653589 | hCV29195260 | rs3851798 | 0.51 | 0.77061721 | 1 |
| hCV341736 | rs11653589 | hCV2959464 | rs3760377 | 0.51 | 0.77061721 | 0.788 |
| hCV341736 | rs11653589 | hCV2959466 | rs6504622 | 0.51 | 0.77061721 | 0.788 |
| hCV341736 | rs11653589 | hCV2960484 | rs11653838 | 0.51 | 0.77061721 | 0.8511 |
| hCV341736 | rs11653589 | hCV30299603 | rs9889762 | 0.51 | 0.77061721 | 0.788 |
| hCV341736 | rs11653589 | hCV31479403 | rs11079750 | 0.51 | 0.77061721 | 0.8526 |
| hCV341736 | rs11653589 | hCV348972 | rs11079747 | 0.51 | 0.77061721 | 0.9616 |
| hCV341736 | rs11653589 | hCV473201 | rs12950699 | 0.51 | 0.77061721 | 0.8598 |
| hCV341736 | rs11653589 | hCV498633 | rs4968304 | 0.51 | 0.77061721 | 0.8598 |
| hCV341736 | rs11653589 | hCV7480314 | rs3851799 | 0.51 | 0.77061721 | 1 |
| hCV341736 | rs11653589 | hCV9268384 | rs7216950 | 0.51 | 0.77061721 | 0.8496 |
| hCV342590 | rs6030 | hCV15756374 | rs2301515 | 0.51 | 0.9 | 0.9345 |
| hCV342590 | rs6030 | hCV16175731 | rs2239852 | 0.51 | 0.9 | 0.9557 |
| hCV342590 | rs6030 | hCV2481728 | rs9332665 | 0.51 | 0.9 | 0.9593 |
| hCV342590 | rs6030 | hCV27490260 | rs3820060 | 0.51 | 0.9 | 0.9557 |
| hCV342590 | rs6030 | hCV30018856 | rs6701330 | 0.51 | 0.9 | 1 |
| hCV342590 | rs6030 | hCV340605 | rs1557572 | 0.51 | 0.9 | 0.9602 |
| hCV342590 | rs6030 | hCV70275 | rs4656687 | 0.51 | 0.9 | 0.9557 |
| hCV342590 | rs6030 | hCV8919436 | rs916438 | 0.51 | 0.9 | 0.9557 |
| hCV342590 | rs6030 | hCV8919438 | rs1557570 | 0.51 | 0.9 | 0.9535 |
| hCV370782 | rs9841174 | hCV186893 | rs2140364 | 0.51 | 0.9 | 0.9787 |
| hCV370782 | rs9841174 | hCV26426702 | rs4955672 | 0.51 | 0.9 | 0.9788 |
| hCV370782 | rs9841174 | hCV26426707 | rs1104570 | 0.51 | 0.9 | 0.9582 |
| hCV370782 | rs9841174 | hCV370768 | rs9823383 | 0.51 | 0.9 | 0.9589 |
| hCV370782 | rs9841174 | hCV452184 | rs6770577 | 0.51 | 0.9 | 0.92 |
| hCV370782 | rs9841174 | hCV82507 | rs4129073 | 0.51 | 0.9 | 1 |
| hCV435368 | rs2812 | hCV11611926 | rs12936766 | 0.51 | 0.9 | 1 |
| hCV435368 | rs2812 | hCV11614606 | rs2070783 | 0.51 | 0.9 | 0.9811 |
| hCV435368 | rs2812 | hCV11614607 | rs2070784 | 0.51 | 0.9 | 1 |
| hCV435368 | rs2812 | hCV25711 | rs9913080 | 0.51 | 0.9 | 1 |
| hCV435368 | rs2812 | hCV432101 | rs4968721 | 0.51 | 0.9 | 1 |
| hCV435368 | rs2812 | hCV435365 | rs6808 | 0.51 | 0.9 | 1 |
| hCV435368 | rs2812 | hCV454546 | rs6504218 | 0.51 | 0.9 | 1 |
| hCV435368 | rs2812 | hCV481442 | rs1122800 | 0.51 | 0.9 | 0.9442 |
| hCV435368 | rs2812 | hCV502420 | rs1050382 | 0.51 | 0.9 | 0.9625 |
| hCV435368 | rs2812 | hCV502421 | rs9902260 | 0.51 | 0.9 | 0.9625 |
| hCV435368 | rs2812 | hCV76415 | rs9303469 | 0.51 | 0.9 | 1 |
| hCV435368 | rs2812 | hCV76416 | rs9303470 | 0.51 | 0.9 | 1 |
| hCV435368 | rs2812 | hCV76418 | rs9892152 | 0.51 | 0.9 | 1 |
| hCV435368 | rs2812 | hCV9489827 | rs1108592 | 0.51 | 0.9 | 1 |
| hCV461035 | rs7746448 | hCV11542275 | rs3105258 | 0.51 | 0.9 | 0.9295 |
| hCV461035 | rs7746448 | hCV11542286 | rs3125275 | 0.51 | 0.9 | 1 |
| hCV461035 | rs7746448 | hCV11559368 | rs6899649 | 0.51 | 0.9 | 0.962 |
| hCV461035 | rs7746448 | hCV11560148 | rs11966562 | 0.51 | 0.9 | 0.962 |
| hCV461035 | rs7746448 | hCV12026670 | rs2047809 | 0.51 | 0.9 | 0.9435 |
| hCV461035 | rs7746448 | hCV238179 | rs9370364 | 0.51 | 0.9 | 1 |
| hCV461035 | rs7746448 | hCV238181 | rs11968305 | 0.51 | 0.9 | 0.9244 |
| hCV461035 | rs7746448 | hCV238185 | rs6914267 | 0.51 | 0.9 | 1 |
| hCV461035 | rs7746448 | hCV26549031 | rs6907460 | 0.51 | 0.9 | 0.9809 |
| hCV461035 | rs7746448 | hCV26549047 | rs4518493 | 0.51 | 0.9 | 0.9226 |
| hCV461035 | rs7746448 | hCV26549113 | rs4236122 | 0.51 | 0.9 | 0.9161 |
| hCV461035 | rs7746448 | hCV27953375 | rs4712088 | 0.51 | 0.9 | 0.962 |
| hCV461035 | rs7746448 | hCV27975017 | rs4398735 | 0.51 | 0.9 | 0.9435 |
| hCV461035 | rs7746448 | hCV29161721 | rs6915903 | 0.51 | 0.9 | 0.9309 |
| hCV461035 | rs7746448 | hCV29161723 | rs7766969 | 0.51 | 0.9 | 0.9435 |
| hCV461035 | rs7746448 | hCV30028095 | rs10456690 | 0.51 | 0.9 | 0.9075 |
| hCV461035 | rs7746448 | hCV30136303 | rs6914527 | 0.51 | 0.9 | 0.9415 |
| hCV461035 | rs7746448 | hCV30225897 | rs9357829 | 0.51 | 0.9 | 0.9309 |
| hCV461035 | rs7746448 | hCV358624 | rs4715508 | 0.51 | 0.9 | 0.9616 |
| hCV472000 | rs3002374 | hCV114713 | rs11145615 | 0.51 | 0.430305154 | 0.8909 |
| hCV472000 | rs3002374 | hCV11760420 | rs2498435 | 0.51 | 0.430305154 | 0.9002 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV472000 | rs3002374 | hCV1463195 | rs11145103 | 0.51 | 0.430305154 | 0.5214 |
| hCV472000 | rs3002374 | hCV15978136 | rs3002375 | 0.51 | 0.430305154 | 1 |
| hCV472000 | rs3002374 | hCV15978147 | rs2498420 | 0.51 | 0.430305154 | 0.9002 |
| hCV472000 | rs3002374 | hCV20899 | rs4237276 | 0.51 | 0.430305154 | 0.8091 |
| hCV472000 | rs3002374 | hCV29033518 | rs7021593 | 0.51 | 0.430305154 | 0.4946 |
| hCV472000 | rs3002374 | hCV29169220 | rs4745688 | 0.51 | 0.430305154 | 0.8953 |
| hCV472000 | rs3002374 | hCV30442834 | rs10481782 | 0.51 | 0.430305154 | 0.8903 |
| hCV472000 | rs3002374 | hCV320070 | rs13286409 | 0.51 | 0.430305154 | 0.8094 |
| hCV472000 | rs3002374 | hCV446684 | rs2252949 | 0.51 | 0.430305154 | 1 |
| hCV472000 | rs3002374 | hCV447339 | rs2486450 | 0.51 | 0.430305154 | 0.8662 |
| hCV472000 | rs3002374 | hCV457907 | rs3002376 | 0.51 | 0.430305154 | 0.9002 |
| hCV472000 | rs3002374 | hCV500457 | rs7018554 | 0.51 | 0.430305154 | 0.9474 |
| hCV472000 | rs3002374 | hCV76127 | rs9411192 | 0.51 | 0.430305154 | 0.9002 |
| hCV472000 | rs3002374 | hCV85712 | rs946541 | 0.51 | 0.430305154 | 0.9474 |
| hCV487868 | rs6439132 | hCV11230071 | rs12490685 | 0.51 | 0.9 | 1 |
| hCV487868 | rs6439132 | hCV26427875 | rs6803892 | 0.51 | 0.9 | 1 |
| hCV487868 | rs6439132 | hCV29665677 | rs7631797 | 0.51 | 0.9 | 1 |
| hCV487868 | rs6439132 | hCV30387127 | rs7629705 | 0.51 | 0.9 | 0.9255 |
| hCV529178 | rs301811 | hCV11398434 | rs1812457 | 0.51 | 0.536691312 | 0.8824 |
| hCV529178 | rs301811 | hCV11398437 | rs1817367 | 0.51 | 0.536691312 | 0.8638 |
| hCV529178 | rs301811 | hCV11675962 | rs10746481 | 0.51 | 0.536691312 | 0.8246 |
| hCV529178 | rs301811 | hCV1188731 | rs4908514 | 0.51 | 0.536691312 | 0.7109 |
| hCV529178 | rs301811 | hCV1188735 | rs10864366 | 0.51 | 0.536691312 | 0.6949 |
| hCV529178 | rs301811 | hCV15882429 | rs2289732 | 0.51 | 0.536691312 | 0.7149 |
| hCV529178 | rs301811 | hCV25996298 | rs7535752 | 0.51 | 0.536691312 | 0.58 |
| hCV529178 | rs301811 | hCV27157507 | rs6664000 | 0.51 | 0.536691312 | 0.6949 |
| hCV529178 | rs301811 | hCV27157524 | rs6577531 | 0.51 | 0.536691312 | 0.659 |
| hCV529178 | rs301811 | hCV2741759 | rs11121179 | 0.51 | 0.536691312 | 0.6991 |
| hCV529178 | rs301811 | hCV27474399 | rs3753275 | 0.51 | 0.536691312 | 0.5818 |
| hCV529178 | rs301811 | hCV27884601 | rs4908776 | 0.51 | 0.536691312 | 0.7101 |
| hCV529178 | rs301811 | hCV27958354 | rs4908762 | 0.51 | 0.536691312 | 1 |
| hCV529178 | rs301811 | hCV28023091 | rs4908773 | 0.51 | 0.536691312 | 0.6949 |
| hCV529178 | rs301811 | hCV29368919 | rs4908513 | 0.51 | 0.536691312 | 0.7109 |
| hCV529178 | rs301811 | hCV2943451 | rs902355 | 0.51 | 0.536691312 | 0.7442 |
| hCV529178 | rs301811 | hCV2943853 | rs301793 | 0.51 | 0.536691312 | 0.7149 |
| hCV529178 | rs301811 | hCV2966436 | rs11121174 | 0.51 | 0.536691312 | 0.7149 |
| hCV529178 | rs301811 | hCV2966437 | rs11580417 | 0.51 | 0.536691312 | 0.7149 |
| hCV529178 | rs301811 | hCV2966441 | rs6684863 | 0.51 | 0.536691312 | 0.7149 |
| hCV529178 | rs301811 | hCV2966444 | rs11121171 | 0.51 | 0.536691312 | 0.767 |
| hCV529178 | rs301811 | hCV29819064 | rs6698079 | 0.51 | 0.536691312 | 0.8488 |
| hCV529178 | rs301811 | hCV2987250 | rs301810 | 0.51 | 0.536691312 | 0.8909 |
| hCV529178 | rs301811 | hCV29873524 | rs7533113 | 0.51 | 0.536691312 | 0.7109 |
| hCV529178 | rs301811 | hCV29873526 | rs6697997 | 0.51 | 0.536691312 | 1 |
| hCV529178 | rs301811 | hCV29945430 | rs7517436 | 0.51 | 0.536691312 | 0.6949 |
| hCV529178 | rs301811 | hCV30035535 | rs7518204 | 0.51 | 0.536691312 | 0.7098 |
| hCV529178 | rs301811 | hCV30125699 | rs4581300 | 0.51 | 0.536691312 | 1 |
| hCV529178 | rs301811 | hCV30143725 | rs6690050 | 0.51 | 0.536691312 | 0.8246 |
| hCV529178 | rs301811 | hCV30467730 | rs6702457 | 0.51 | 0.536691312 | 0.8246 |
| hCV529178 | rs301811 | hCV3086930 | rs6658881 | 0.51 | 0.536691312 | 0.8149 |
| hCV529178 | rs301811 | hCV3086932 | rs7533442 | 0.51 | 0.536691312 | 0.8149 |
| hCV529178 | rs301811 | hCV3086950 | rs4908771 | 0.51 | 0.536691312 | 0.8246 |
| hCV529178 | rs301811 | hCV3086961 | rs6703577 | 0.51 | 0.536691312 | 0.8759 |
| hCV529178 | rs301811 | hCV3086971 | rs6679948 | 0.51 | 0.536691312 | 0.8824 |
| hCV529178 | rs301811 | hCV3086972 | rs6688329 | 0.51 | 0.536691312 | 0.8759 |
| hCV529178 | rs301811 | hCV3086998 | rs7530863 | 0.51 | 0.536691312 | 1 |
| hCV529178 | rs301811 | hCV3087000 | rs1463055 | 0.51 | 0.536691312 | 1 |
| hCV529178 | rs301811 | hCV3087003 | rs6577500 | 0.51 | 0.536691312 | 1 |
| hCV529178 | rs301811 | hCV3087015 | rs11121198 | 0.51 | 0.536691312 | 1 |
| hCV529178 | rs301811 | hCV3087016 | rs2297867 | 0.51 | 0.536691312 | 1 |
| hCV529178 | rs301811 | hCV32055284 | rs12079653 | 0.51 | 0.536691312 | 0.6985 |
| hCV529178 | rs301811 | hCV32055470 | rs6577506 | 0.51 | 0.536691312 | 0.8759 |
| hCV529178 | rs301811 | hCV32055474 | rs10864359 | 0.51 | 0.536691312 | 0.8759 |
| hCV529178 | rs301811 | hCV32055477 | rs10779705 | 0.51 | 0.536691312 | 0.8824 |
| hCV529178 | rs301811 | hCV32055527 | rs10864364 | 0.51 | 0.536691312 | 0.6949 |
| hCV529178 | rs301811 | hCV32055548 | rs11121197 | 0.51 | 0.536691312 | 1 |
| hCV529178 | rs301811 | hCV32055579 | rs6577522 | 0.51 | 0.536691312 | 0.7106 |
| hCV529178 | rs301811 | hCV32055595 | rs6577524 | 0.51 | 0.536691312 | 0.7109 |
| hCV529178 | rs301811 | hCV32055596 | rs6577525 | 0.51 | 0.536691312 | 0.6949 |
| hCV529178 | rs301811 | hCV32055625 | rs6678590 | 0.51 | 0.536691312 | 0.6074 |
| hCV529178 | rs301811 | hCV32055637 | rs6577532 | 0.51 | 0.536691312 | 0.6401 |
| hCV529178 | rs301811 | hCV32055677 | rs10864355 | 0.51 | 0.536691312 | 1 |
| hCV529178 | rs301811 | hCV529182 | rs301800 | 0.51 | 0.536691312 | 0.7543 |
| hCV529178 | rs301811 | hCV597227 | rs301809 | 0.51 | 0.536691312 | 1 |
| hCV529178 | rs301811 | hCV597229 | rs301785 | 0.51 | 0.536691312 | 1 |
| hCV529178 | rs301811 | hCV877241 | rs301788 | 0.51 | 0.536691312 | 0.6991 |
| hCV529178 | rs301811 | hCV8823713 | rs1472228 | 0.51 | 0.536691312 | 0.6949 |
| hCV529178 | rs301811 | hCV8824288 | rs910582 | 0.51 | 0.536691312 | 1 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV529178 | rs301811 | hCV8824394 | rs1443929 | 0.51 | 0.536691312 | 0.6991 |
| hCV529178 | rs301811 | hCV8824424 | rs1058790 | 0.51 | 0.536691312 | 0.767 |
| hCV529178 | rs301811 | hCV8824425 | rs1058791 | 0.51 | 0.536691312 | 0.7538 |
| hCV529178 | rs301811 | hCV8881145 | rs1038008 | 0.51 | 0.536691312 | 0.8824 |
| hCV529178 | rs301811 | hCV8881146 | rs1463054 | 0.51 | 0.536691312 | 0.8271 |
| hCV529178 | rs301811 | hCV8881157 | rs1535158 | 0.51 | 0.536691312 | 0.8824 |
| hCV529178 | rs301811 | hCV8881161 | rs926951 | 0.51 | 0.536691312 | 1 |
| hCV529706 | rs428785 | hCV1129216 | rs370850 | 0.51 | 0.9 | 0.9486 |
| hCV529706 | rs428785 | hCV1129217 | rs416905 | 0.51 | 0.9 | 0.9486 |
| hCV529706 | rs428785 | hCV1129218 | rs420742 | 0.51 | 0.9 | 0.9486 |
| hCV529706 | rs428785 | hCV11799502 | rs392840 | 0.51 | 0.9 | 0.9486 |
| hCV529706 | rs428785 | hCV529701 | rs422381 | 0.51 | 0.9 | 0.9523 |
| hCV529706 | rs428785 | hCV529703 | rs451792 | 0.51 | 0.9 | 0.9523 |
| hCV529706 | rs428785 | hCV529708 | rs445784 | 0.51 | 0.9 | 0.9507 |
| hCV537525 | rs197943 | hCV15885004 | rs2277614 | 0.51 | 0.550075489 | 0.6606 |
| hCV537525 | rs197943 | hCV2275251 | rs197927 | 0.51 | 0.550075489 | 1 |
| hCV537525 | rs197943 | hCV2275252 | rs197928 | 0.51 | 0.550075489 | 1 |
| hCV537525 | rs197943 | hCV2960488 | rs197909 | 0.51 | 0.550075489 | 1 |
| hCV537525 | rs197943 | hCV7451329 | rs197938 | 0.51 | 0.550075489 | 1 |
| hCV549926 | rs1057141 | hCV16222565 | rs2395269 | 0.51 | 0.9 | 0.921 |
| hCV549926 | rs1057141 | hCV27015215 | rs2071482 | 0.51 | 0.9 | 0.9603 |
| hCV549926 | rs1057141 | hCV2961762 | rs12529313 | 0.51 | 0.9 | 1 |
| hCV549926 | rs1057141 | hCV2961763 | rs12527715 | 0.51 | 0.9 | 1 |
| hCV597227 | rs301809 | hCV11398434 | rs1812457 | 0.51 | 0.533875411 | 0.8824 |
| hCV597227 | rs301809 | hCV11398437 | rs1817367 | 0.51 | 0.533875411 | 0.8638 |
| hCV597227 | rs301809 | hCV11675962 | rs10746481 | 0.51 | 0.533875411 | 0.8248 |
| hCV597227 | rs301809 | hCV1188731 | rs4908514 | 0.51 | 0.533875411 | 0.7112 |
| hCV597227 | rs301809 | hCV1188735 | rs10864366 | 0.51 | 0.533875411 | 0.6952 |
| hCV597227 | rs301809 | hCV15882429 | rs2289732 | 0.51 | 0.533875411 | 0.7153 |
| hCV597227 | rs301809 | hCV25996298 | rs7535752 | 0.51 | 0.533875411 | 0.5809 |
| hCV597227 | rs301809 | hCV27157507 | rs6664000 | 0.51 | 0.533875411 | 0.6952 |
| hCV597227 | rs301809 | hCV27157524 | rs6577531 | 0.51 | 0.533875411 | 0.6596 |
| hCV597227 | rs301809 | hCV2741759 | rs11121179 | 0.51 | 0.533875411 | 0.6996 |
| hCV597227 | rs301809 | hCV27474399 | rs3753275 | 0.51 | 0.533875411 | 0.5827 |
| hCV597227 | rs301809 | hCV27884601 | rs4908776 | 0.51 | 0.533875411 | 0.7103 |
| hCV597227 | rs301809 | hCV27958354 | rs4908762 | 0.51 | 0.533875411 | 1 |
| hCV597227 | rs301809 | hCV28023091 | rs4908773 | 0.51 | 0.533875411 | 0.6952 |
| hCV597227 | rs301809 | hCV29368919 | rs4908513 | 0.51 | 0.533875411 | 0.7112 |
| hCV597227 | rs301809 | hCV2943451 | rs902355 | 0.51 | 0.533875411 | 0.7442 |
| hCV597227 | rs301809 | hCV2943853 | rs301793 | 0.51 | 0.533875411 | 0.7153 |
| hCV597227 | rs301809 | hCV2966436 | rs11121174 | 0.51 | 0.533875411 | 0.7153 |
| hCV597227 | rs301809 | hCV2966437 | rs11580417 | 0.51 | 0.533875411 | 0.7153 |
| hCV597227 | rs301809 | hCV2966441 | rs6684863 | 0.51 | 0.533875411 | 0.7153 |
| hCV597227 | rs301809 | hCV2966444 | rs11121171 | 0.51 | 0.533875411 | 0.7672 |
| hCV597227 | rs301809 | hCV29819064 | rs6698079 | 0.51 | 0.533875411 | 0.8488 |
| hCV597227 | rs301809 | hCV2987250 | rs301810 | 0.51 | 0.533875411 | 0.8909 |
| hCV597227 | rs301809 | hCV29873524 | rs7533113 | 0.51 | 0.533875411 | 0.7112 |
| hCV597227 | rs301809 | hCV29873526 | rs6697997 | 0.51 | 0.533875411 | 1 |
| hCV597227 | rs301809 | hCV29945430 | rs7517436 | 0.51 | 0.533875411 | 0.6952 |
| hCV597227 | rs301809 | hCV30035535 | rs7518204 | 0.51 | 0.533875411 | 0.7101 |
| hCV597227 | rs301809 | hCV30125699 | rs4581300 | 0.51 | 0.533875411 | 1 |
| hCV597227 | rs301809 | hCV30143725 | rs6690050 | 0.51 | 0.533875411 | 0.8248 |
| hCV597227 | rs301809 | hCV30467730 | rs6702457 | 0.51 | 0.533875411 | 0.8248 |
| hCV597227 | rs301809 | hCV3086930 | rs6658881 | 0.51 | 0.533875411 | 0.815 |
| hCV597227 | rs301809 | hCV3086932 | rs7533442 | 0.51 | 0.533875411 | 0.815 |
| hCV597227 | rs301809 | hCV3086950 | rs4908771 | 0.51 | 0.533875411 | 0.8248 |
| hCV597227 | rs301809 | hCV3086961 | rs6703577 | 0.51 | 0.533875411 | 0.8759 |
| hCV597227 | rs301809 | hCV3086971 | rs6679948 | 0.51 | 0.533875411 | 0.8824 |
| hCV597227 | rs301809 | hCV3086972 | rs6688329 | 0.51 | 0.533875411 | 0.8759 |
| hCV597227 | rs301809 | hCV3086998 | rs7530863 | 0.51 | 0.533875411 | 1 |
| hCV597227 | rs301809 | hCV3087000 | rs1463055 | 0.51 | 0.533875411 | 1 |
| hCV597227 | rs301809 | hCV3087003 | rs6577500 | 0.51 | 0.533875411 | 1 |
| hCV597227 | rs301809 | hCV3087015 | rs11121198 | 0.51 | 0.533875411 | 1 |
| hCV597227 | rs301809 | hCV3087016 | rs2297867 | 0.51 | 0.533875411 | 1 |
| hCV597227 | rs301809 | hCV32055284 | rs12079653 | 0.51 | 0.533875411 | 0.6985 |
| hCV597227 | rs301809 | hCV32055470 | rs6577506 | 0.51 | 0.533875411 | 0.8759 |
| hCV597227 | rs301809 | hCV32055474 | rs10864359 | 0.51 | 0.533875411 | 0.8759 |
| hCV597227 | rs301809 | hCV32055477 | rs10779705 | 0.51 | 0.533875411 | 0.8824 |
| hCV597227 | rs301809 | hCV32055527 | rs10864364 | 0.51 | 0.533875411 | 0.6952 |
| hCV597227 | rs301809 | hCV32055548 | rs11121197 | 0.51 | 0.533875411 | 1 |
| hCV597227 | rs301809 | hCV32055579 | rs6577522 | 0.51 | 0.533875411 | 0.7109 |
| hCV597227 | rs301809 | hCV32055595 | rs6577524 | 0.51 | 0.533875411 | 0.7112 |
| hCV597227 | rs301809 | hCV32055596 | rs6577525 | 0.51 | 0.533875411 | 0.6952 |
| hCV597227 | rs301809 | hCV32055625 | rs6678590 | 0.51 | 0.533875411 | 0.6074 |
| hCV597227 | rs301809 | hCV32055637 | rs6577532 | 0.51 | 0.533875411 | 0.6408 |
| hCV597227 | rs301809 | hCV32055677 | rs10864355 | 0.51 | 0.533875411 | 1 |
| hCV597227 | rs301809 | hCV529178 | rs301811 | 0.51 | 0.533875411 | 1 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV597227 | rs301809 | hCV529182 | rs301800 | 0.51 | 0.533875411 | 0.7545 |
| hCV597227 | rs301809 | hCV597229 | rs301785 | 0.51 | 0.533875411 | 1 |
| hCV597227 | rs301809 | hCV877241 | rs301788 | 0.51 | 0.533875411 | 0.6996 |
| hCV597227 | rs301809 | hCV8823713 | rs1472228 | 0.51 | 0.533875411 | 0.6952 |
| hCV597227 | rs301809 | hCV8824288 | rs910582 | 0.51 | 0.533875411 | 1 |
| hCV597227 | rs301809 | hCV8824394 | rs1443929 | 0.51 | 0.533875411 | 0.6996 |
| hCV597227 | rs301809 | hCV8824424 | rs1058790 | 0.51 | 0.533875411 | 0.7672 |
| hCV597227 | rs301809 | hCV8824425 | rs1058791 | 0.51 | 0.533875411 | 0.754 |
| hCV597227 | rs301809 | hCV8881145 | rs1038008 | 0.51 | 0.533875411 | 0.8824 |
| hCV597227 | rs301809 | hCV8881146 | rs1463054 | 0.51 | 0.533875411 | 0.8271 |
| hCV597227 | rs301809 | hCV8881157 | rs1535158 | 0.51 | 0.533875411 | 0.8824 |
| hCV597227 | rs301809 | hCV8881161 | rs926951 | 0.51 | 0.533875411 | 1 |
| hCV598677 | rs5370 | hCV15870027 | rs2071943 | 0.51 | 0.9 | 0.9736 |
| hCV598677 | rs5370 | hCV7464888 | rs1800543 | 0.51 | 0.9 | 0.9732 |
| hCV598677 | rs5370 | hCV7464890 | rs1476046 | 0.51 | 0.9 | 0.9736 |
| hCV601946 | rs524802 | hCV11467059 | rs472226 | 0.51 | 0.9 | 0.9624 |
| hCV601946 | rs524802 | hCV25994206 | rs3745770 | 0.51 | 0.9 | 0.9307 |
| hCV601946 | rs524802 | hCV26697405 | rs547483 | 0.51 | 0.9 | 0.9624 |
| hCV601946 | rs524802 | hCV26697407 | rs496872 | 0.51 | 0.9 | 0.9649 |
| hCV601946 | rs524802 | hCV27493801 | rs3745768 | 0.51 | 0.9 | 0.9307 |
| hCV601946 | rs524802 | hCV30209952 | rs10403679 | 0.51 | 0.9 | 0.9604 |
| hCV601946 | rs524802 | hCV601938 | rs519551 | 0.51 | 0.9 | 0.9649 |
| hCV601946 | rs524802 | hCV601939 | rs565721 | 0.51 | 0.9 | 0.9649 |
| hCV601946 | rs524802 | hCV601940 | rs474017 | 0.51 | 0.9 | 0.9624 |
| hCV601946 | rs524802 | hCV601941 | rs569371 | 0.51 | 0.9 | 0.9604 |
| hCV601946 | rs524802 | hCV601945 | rs528504 | 0.51 | 0.9 | 0.9624 |
| hCV601946 | rs524802 | hCV601954 | rs513406 | 0.51 | 0.9 | 0.9649 |
| hCV601946 | rs524802 | hCV8712373 | rs1667343 | 0.51 | 0.9 | 0.9639 |
| hCV601946 | rs524802 | hCV8712515 | rs826304 | 0.51 | 0.9 | 0.9624 |
| hCV601946 | rs524802 | hCV8712596 | rs826303 | 0.51 | 0.9 | 0.9649 |
| hCV601946 | rs524802 | hCV8712603 | rs826296 | 0.51 | 0.9 | 0.9642 |
| hCV601946 | rs524802 | hDV70773633 | rs16971873 | 0.51 | 0.9 | 0.9649 |
| hCV601961 | rs568654 | hCV11467027 | rs826262 | 0.51 | 0.9 | 1 |
| hCV601961 | rs568654 | hCV32351622 | rs519606 | 0.51 | 0.9 | 0.9649 |
| hCV601961 | rs568654 | hCV601959 | rs540451 | 0.51 | 0.9 | 1 |
| hCV601961 | rs568654 | hCV601962 | rs544543 | 0.51 | 0.9 | 1 |
| hCV601961 | rs568654 | hCV601964 | rs505717 | 0.51 | 0.9 | 1 |
| hCV601961 | rs568654 | hCV601966 | rs551717 | 0.51 | 0.9 | 1 |
| hCV601961 | rs568654 | hCV601969 | rs510757 | 0.51 | 0.9 | 1 |
| hCV601961 | rs568654 | hCV601972 | rs484001 | 0.51 | 0.9 | 1 |
| hCV601961 | rs568654 | hCV8712620 | rs826290 | 0.51 | 0.9 | 1 |
| hCV601961 | rs568654 | hCV8712646 | rs1644711 | 0.51 | 0.9 | 1 |
| hCV601962 | rs544543 | hCV11467027 | rs826262 | 0.51 | 0.9 | 1 |
| hCV601962 | rs544543 | hCV32351622 | rs519606 | 0.51 | 0.9 | 0.9658 |
| hCV601962 | rs544543 | hCV601959 | rs540451 | 0.51 | 0.9 | 1 |
| hCV601962 | rs544543 | hCV601961 | rs568654 | 0.51 | 0.9 | 1 |
| hCV601962 | rs544543 | hCV601964 | rs505717 | 0.51 | 0.9 | 1 |
| hCV601962 | rs544543 | hCV601966 | rs551717 | 0.51 | 0.9 | 1 |
| hCV601962 | rs544543 | hCV601969 | rs510757 | 0.51 | 0.9 | 1 |
| hCV601962 | rs544543 | hCV601972 | rs484001 | 0.51 | 0.9 | 1 |
| hCV601962 | rs544543 | hCV8712620 | rs826290 | 0.51 | 0.9 | 1 |
| hCV601962 | rs544543 | hCV8712646 | rs1644711 | 0.51 | 0.9 | 1 |
| hCV610861 | rs636887 | hCV8821402 | rs1076052 | 0.51 | 0.9 | 1 |
| hCV621313 | rs471364 | hCV16053903 | rs2616751 | 0.51 | 0.9 | 1 |
| hCV621313 | rs471364 | hCV27926761 | rs3933785 | 0.51 | 0.9 | 1 |
| hCV621313 | rs471364 | hCV27993845 | rs3933784 | 0.51 | 0.9 | 1 |
| hCV621313 | rs471364 | hCV28015592 | rs4237138 | 0.51 | 0.9 | 1 |
| hCV621313 | rs471364 | hCV31935994 | rs1475229 | 0.51 | 0.9 | 1 |
| hCV7442005 | rs1538584 | hCV11759640 | rs7850573 | 0.51 | 0.495145847 | 0.6452 |
| hCV7442005 | rs1538584 | hCV11759644 | rs6560584 | 0.51 | 0.495145847 | 0.6452 |
| hCV7442005 | rs1538584 | hCV11759645 | rs7034303 | 0.51 | 0.495145847 | 0.6452 |
| hCV7442005 | rs1538584 | hCV11759647 | rs7048937 | 0.51 | 0.495145847 | 0.6452 |
| hCV7442005 | rs1538584 | hCV11760387 | rs2309422 | 0.51 | 0.495145847 | 0.6742 |
| hCV7442005 | rs1538584 | hCV11760421 | rs12056979 | 0.51 | 0.495145847 | 0.6526 |
| hCV7442005 | rs1538584 | hCV11761216 | rs7874888 | 0.51 | 0.495145847 | 0.6359 |
| hCV7442005 | rs1538584 | hCV11761223 | rs2309426 | 0.51 | 0.495145847 | 0.6079 |
| hCV7442005 | rs1538584 | hCV11761237 | rs4329331 | 0.51 | 0.495145847 | 0.6742 |
| hCV7442005 | rs1538584 | hCV11761239 | rs4338173 | 0.51 | 0.495145847 | 0.6742 |
| hCV7442005 | rs1538584 | hCV11761245 | rs7043149 | 0.51 | 0.495145847 | 1 |
| hCV7442005 | rs1538584 | hCV1844076 | rs1339546 | 0.51 | 0.495145847 | 0.7161 |
| hCV7442005 | rs1538584 | hCV20896 | rs2309424 | 0.51 | 0.495145847 | 0.7161 |
| hCV7442005 | rs1538584 | hCV25805877 | rs3750549 | 0.51 | 0.495145847 | 0.6376 |
| hCV7442005 | rs1538584 | hCV26566188 | rs4375066 | 0.51 | 0.495145847 | 0.6691 |
| hCV7442005 | rs1538584 | hCV26566190 | rs3927676 | 0.51 | 0.495145847 | 0.6691 |
| hCV7442005 | rs1538584 | hCV26566432 | rs4076288 | 0.51 | 0.495145847 | 0.8185 |
| hCV7442005 | rs1538584 | hCV26566437 | rs4421408 | 0.51 | 0.495145847 | 0.6526 |
| hCV7442005 | rs1538584 | hCV26566445 | rs4339703 | 0.51 | 0.495145847 | 0.8065 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV7442005 | rs1538584 | hCV27970553 | rs5006364 | 0.51 | 0.495145847 | 0.8065 |
| hCV7442005 | rs1538584 | hCV27996874 | rs4745701 | 0.51 | 0.495145847 | 0.9644 |
| hCV7442005 | rs1538584 | hCV29169289 | rs6560585 | 0.51 | 0.495145847 | 0.6452 |
| hCV7442005 | rs1538584 | hCV29577088 | rs9314865 | 0.51 | 0.495145847 | 0.7161 |
| hCV7442005 | rs1538584 | hCV29830130 | rs10217168 | 0.51 | 0.495145847 | 0.7161 |
| hCV7442005 | rs1538584 | hCV30172680 | rs10122932 | 0.51 | 0.495145847 | 0.6452 |
| hCV7442005 | rs1538584 | hCV30532761 | rs10125494 | 0.51 | 0.495145847 | 0.6526 |
| hCV7442005 | rs1538584 | hCV31363642 | rs7862404 | 0.51 | 0.495145847 | 0.6403 |
| hCV7442005 | rs1538584 | hCV31363652 | rs10869961 | 0.51 | 0.495145847 | 0.6526 |
| hCV7442005 | rs1538584 | hCV31363664 | rs10869975 | 0.51 | 0.495145847 | 0.6889 |
| hCV7442005 | rs1538584 | hCV31363697 | rs7041781 | 0.51 | 0.495145847 | 0.6376 |
| hCV7442005 | rs1538584 | hCV31364135 | rs10781440 | 0.51 | 0.495145847 | 0.6798 |
| hCV7442005 | rs1538584 | hCV31364138 | rs7865373 | 0.51 | 0.495145847 | 0.6798 |
| hCV7442005 | rs1538584 | hCV31364140 | rs7467352 | 0.51 | 0.495145847 | 0.6455 |
| hCV7442005 | rs1538584 | hCV31364141 | rs11145460 | 0.51 | 0.495145847 | 0.6661 |
| hCV7442005 | rs1538584 | hCV446682 | rs2309427 | 0.51 | 0.495145847 | 0.6359 |
| hCV7442005 | rs1538584 | hCV450641 | rs10781456 | 0.51 | 0.495145847 | 0.6798 |
| hCV7442005 | rs1538584 | hCV453560 | rs10869992 | 0.51 | 0.495145847 | 0.6742 |
| hCV7442005 | rs1538584 | hCV453561 | rs10869993 | 0.51 | 0.495145847 | 0.6641 |
| hCV7442005 | rs1538584 | hCV453562 | rs10869994 | 0.51 | 0.495145847 | 0.6742 |
| hCV7442005 | rs1538584 | hCV453563 | rs10869997 | 0.51 | 0.495145847 | 0.678 |
| hCV7442005 | rs1538584 | hCV456556 | rs4076287 | 0.51 | 0.495145847 | 0.6673 |
| hCV7442005 | rs1538584 | hCV463630 | rs2486451 | 0.51 | 0.495145847 | 1 |
| hCV7442005 | rs1538584 | hCV500456 | rs10869976 | 0.51 | 0.495145847 | 0.6857 |
| hCV7442005 | rs1538584 | hCV7441996 | rs867346 | 0.51 | 0.495145847 | 0.6831 |
| hCV7442005 | rs1538584 | hCV7442003 | rs884428 | 0.51 | 0.495145847 | 0.6691 |
| hCV7442005 | rs1538584 | hCV7442004 | rs884429 | 0.51 | 0.495145847 | 0.6691 |
| hCV7442005 | rs1538584 | hCV7482544 | rs1416738 | 0.51 | 0.495145847 | 0.6798 |
| hCV7442005 | rs1538584 | hDV70840481 | rs17062237 | 0.51 | 0.495145847 | 0.6742 |
| hCV7442005 | rs1538584 | hDV71162544 | rs1416739 | 0.51 | 0.495145847 | 0.6567 |
| hCV7442005 | rs1538584 | hDV81101901 | rs4745650 | 0.51 | 0.495145847 | 0.6526 |
| hCV7443062 | rs897453 | hCV7443053 | rs1108579 | 0.51 | 0.9 | 0.9298 |
| hCV7480314 | rs3851799 | hCV16192346 | rs2316758 | 0.51 | 0.769799979 | 1 |
| hCV7480314 | rs3851799 | hCV2592673 | rs4968286 | 0.51 | 0.769799979 | 0.788 |
| hCV7480314 | rs3851799 | hCV2592715 | rs3851792 | 0.51 | 0.769799979 | 1 |
| hCV7480314 | rs3851799 | hCV26660327 | rs11869840 | 0.51 | 0.769799979 | 0.788 |
| hCV7480314 | rs3851799 | hCV27899058 | rs4074249 | 0.51 | 0.769799979 | 0.8511 |
| hCV7480314 | rs3851799 | hCV29195255 | rs8068715 | 0.51 | 0.769799979 | 1 |
| hCV7480314 | rs3851799 | hCV29195260 | rs3851798 | 0.51 | 0.769799979 | 1 |
| hCV7480314 | rs3851799 | hCV2959464 | rs3760377 | 0.51 | 0.769799979 | 0.788 |
| hCV7480314 | rs3851799 | hCV2959466 | rs6504622 | 0.51 | 0.769799979 | 0.788 |
| hCV7480314 | rs3851799 | hCV2960484 | rs11653838 | 0.51 | 0.769799979 | 0.8511 |
| hCV7480314 | rs3851799 | hCV30299603 | rs9889762 | 0.51 | 0.769799979 | 0.788 |
| hCV7480314 | rs3851799 | hCV31479403 | rs11079750 | 0.51 | 0.769799979 | 0.8526 |
| hCV7480314 | rs3851799 | hCV341736 | rs11653589 | 0.51 | 0.769799979 | 1 |
| hCV7480314 | rs3851799 | hCV348972 | rs11079747 | 0.51 | 0.769799979 | 0.9616 |
| hCV7480314 | rs3851799 | hCV473201 | rs12950699 | 0.51 | 0.769799979 | 0.8598 |
| hCV7480314 | rs3851799 | hCV498633 | rs4968304 | 0.51 | 0.769799979 | 0.8598 |
| hCV7480314 | rs3851799 | hCV9268384 | rs7216950 | 0.51 | 0.769799979 | 0.8496 |
| hCV7490135 | rs1805082 | hCV12087046 | rs1808579 | 0.51 | 0.9 | 0.9437 |
| hCV7490135 | rs1805082 | hCV16017395 | rs2435307 | 0.51 | 0.9 | 0.9439 |
| hCV7490135 | rs1805082 | hCV16023276 | rs2510340 | 0.51 | 0.9 | 0.931 |
| hCV7490135 | rs1805082 | hCV25620752 | rs7239575 | 0.51 | 0.9 | 1 |
| hCV7490135 | rs1805082 | hCV27004508 | rs2960578 | 0.51 | 0.9 | 0.9628 |
| hCV7490135 | rs1805082 | hCV2950793 | rs1652343 | 0.51 | 0.9 | 0.9628 |
| hCV7490135 | rs1805082 | hCV29636546 | rs1652344 | 0.51 | 0.9 | 1 |
| hCV7490135 | rs1805082 | hCV3203990 | rs1429935 | 0.51 | 0.9 | 0.9624 |
| hCV7490135 | rs1805082 | hCV3203995 | rs1367083 | 0.51 | 0.9 | 0.9623 |
| hCV7490135 | rs1805082 | hCV3203996 | rs6507708 | 0.51 | 0.9 | 0.931 |
| hCV7490135 | rs1805082 | hCV3204000 | rs891387 | 0.51 | 0.9 | 0.9628 |
| hCV7490135 | rs1805082 | hCV3204001 | rs891386 | 0.51 | 0.9 | 0.9271 |
| hCV7490135 | rs1805082 | hCV3204007 | rs2510344 | 0.51 | 0.9 | 1 |
| hCV7490135 | rs1805082 | hCV3204010 | rs6507716 | 0.51 | 0.9 | 0.9812 |
| hCV7490135 | rs1805082 | hCV3204011 | rs12964689 | 0.51 | 0.9 | 1 |
| hCV7490135 | rs1805082 | hCV3204012 | rs4800162 | 0.51 | 0.9 | 1 |
| hCV7490135 | rs1805082 | hCV3204013 | rs4800488 | 0.51 | 0.9 | 1 |
| hCV7490135 | rs1805082 | hCV3204015 | rs6507720 | 0.51 | 0.9 | 1 |
| hCV7490135 | rs1805082 | hCV3204021 | rs11663558 | 0.51 | 0.9 | 0.9271 |
| hCV7490135 | rs1805082 | hCV3204027 | rs1623060 | 0.51 | 0.9 | 0.9628 |
| hCV7490135 | rs1805082 | hCV3204029 | rs1652348 | 0.51 | 0.9 | 1 |
| hCV7490135 | rs1805082 | hCV3204038 | rs1788783 | 0.51 | 0.9 | 0.9628 |
| hCV7490135 | rs1805082 | hCV7490108 | rs1631685 | 0.51 | 0.9 | 0.9628 |
| hCV7490135 | rs1805082 | hCV7490208 | rs1788817 | 0.51 | 0.9 | 0.9436 |
| hCV7490135 | rs1805082 | hDV77046157 | rs4800493 | 0.51 | 0.9 | 0.931 |
| hCV7501549 | rs1467412 | hCV16230554 | rs2426320 | 0.51 | 0.9 | 1 |
| hCV7501549 | rs1467412 | hCV16230588 | rs2426329 | 0.51 | 0.9 | 1 |
| hCV7501549 | rs1467412 | hCV25618186 | rs1467413 | 0.51 | 0.9 | 1 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV7501549 | rs1467412 | hCV3120998 | rs2253381 | 0.51 | 0.9 | 1 |
| hCV7501549 | rs1467412 | hCV3120999 | rs2426318 | 0.51 | 0.9 | 1 |
| hCV7501549 | rs1467412 | hCV3121000 | rs2426319 | 0.51 | 0.9 | 1 |
| hCV7501549 | rs1467412 | hCV3121001 | rs2426321 | 0.51 | 0.9 | 1 |
| hCV7501549 | rs1467412 | hCV3121002 | rs2426322 | 0.51 | 0.9 | 1 |
| hCV7514870 | rs1041981 | hCV2451911 | rs909253 | 0.51 | 0.9 | 1 |
| hCV7514870 | rs1041981 | hCV26778971 | rs2071591 | 0.51 | 0.9 | 0.9791 |
| hCV7514870 | rs1041981 | hCV27463589 | rs3130059 | 0.51 | 0.9 | 0.9621 |
| hCV7514870 | rs1041981 | hCV30139067 | rs3093974 | 0.51 | 0.9 | 0.958 |
| hCV7514870 | rs1041981 | hCV3273586 | rs2071592 | 0.51 | 0.9 | 0.9234 |
| hCV7514870 | rs1041981 | hCV3273591 | rs2071594 | 0.51 | 0.9 | 0.9791 |
| hCV7514870 | rs1041981 | hCV3273597 | rs2239527 | 0.51 | 0.9 | 0.96 |
| hCV7514870 | rs1041981 | hCV3273612 | rs11796 | 0.51 | 0.9 | 0.9791 |
| hCV7514879 | rs1800629 | hCV26778874 | rs2516482 | 0.51 | 0.9 | 1 |
| hCV7514879 | rs1800629 | hCV30319025 | rs3093988 | 0.51 | 0.9 | 0.9366 |
| hCV7537517 | rs1501908 | hCV1454065 | rs12657266 | 0.51 | 0.9 | 1 |
| hCV7537517 | rs1501908 | hCV1454067 | rs6874202 | 0.51 | 0.9 | 1 |
| hCV7537517 | rs1501908 | hCV27868704 | rs4704727 | 0.51 | 0.9 | 1 |
| hCV7537517 | rs1501908 | hCV29133696 | rs7724832 | 0.51 | 0.9 | 1 |
| hCV7537517 | rs1501908 | hCV31236212 | rs6878680 | 0.51 | 0.9 | 1 |
| hCV7537517 | rs1501908 | hCV3164263 | rs1363232 | 0.51 | 0.9 | 1 |
| hCV7577801 | rs11876 | hDV75439516 | rs3211994 | 0.51 | 0.9 | 1 |
| hCV7618856 | rs1143675 | hCV1711157 | rs1196184 | 0.51 | 0.9 | 1 |
| hCV783138 | rs6046 | hCV11926372 | rs6041 | 0.51 | 0.9 | 0.9575 |
| hCV783138 | rs6046 | hCV3046089 | rs6042 | 0.51 | 0.9 | 0.9165 |
| hCV783138 | rs6046 | hCV31891145 | rs3093253 | 0.51 | 0.9 | 0.9576 |
| hCV783138 | rs6046 | hCV50000100 | rs561241 | 0.51 | 0.9 | 0.9234 |
| hCV783138 | rs6046 | hCV783148 | rs491098 | 0.51 | 0.9 | 0.9165 |
| hCV7900503 | rs3732379 | hCV246550 | rs11713282 | 0.51 | 0.9 | 1 |
| hCV7900503 | rs3732379 | hCV246551 | rs11129819 | 0.51 | 0.9 | 1 |
| hCV7900503 | rs3732379 | hCV403264 | rs11711391 | 0.51 | 0.9 | 1 |
| hCV7900503 | rs3732379 | hCV7900501 | rs11709600 | 0.51 | 0.9 | 1 |
| hCV7900503 | rs3732379 | hCV7900502 | rs11710546 | 0.51 | 0.9 | 1 |
| hCV7900503 | rs3732379 | hCV8759805 | rs1050592 | 0.51 | 0.9 | 1 |
| hCV7910239 | rs1541296 | hCV3044407 | rs2003149 | 0.51 | 0.9 | 1 |
| hCV7910239 | rs1541296 | hCV3044408 | rs1809319 | 0.51 | 0.9 | 1 |
| hCV795441 | rs401502 | hCV795442 | rs375947 | 0.51 | 0.9 | 1 |
| hCV795441 | rs401502 | hCV795446 | rs365179 | 0.51 | 0.9 | 0.9581 |
| hCV795441 | rs401502 | hDV795454 | rs429774 | 0.51 | 0.9 | 1 |
| hCV795441 | rs401502 | hCV795455 | rs382634 | 0.51 | 0.9 | 0.9103 |
| hCV795441 | rs401502 | hCV795459 | rs376008 | 0.51 | 0.9 | 1 |
| hCV795441 | rs401502 | hDV71612301 | rs17852635 | 0.51 | 0.9 | 1 |
| hCV795442 | rs375947 | hCV795441 | rs401502 | 0.51 | 0.9 | 1 |
| hCV795442 | rs375947 | hCV795446 | rs365179 | 0.51 | 0.9 | 0.9552 |
| hCV795442 | rs375947 | hCV795454 | rs429774 | 0.51 | 0.9 | 0.9795 |
| hCV795442 | rs375947 | hCV795455 | rs382634 | 0.51 | 0.9 | 0.9059 |
| hCV795442 | rs375947 | hCV795459 | rs376008 | 0.51 | 0.9 | 1 |
| hCV795442 | rs375947 | hDV71612301 | rs17852635 | 0.51 | 0.9 | 0.9795 |
| hCV818008 | rs5918 | hCV29197695 | rs7214096 | 0.51 | 0.9 | 1 |
| hCV818008 | rs5918 | hCV29197704 | rs8069732 | 0.51 | 0.9 | 1 |
| hCV8369472 | rs1447351 | hCV11323166 | rs7121092 | 0.51 | 0.9 | 1 |
| hCV8369472 | rs1447351 | hCV26158785 | rs4406791 | 0.51 | 0.9 | 0.9649 |
| hCV8369472 | rs1447351 | hCV26158787 | rs4753073 | 0.51 | 0.9 | 1 |
| hCV8369472 | rs1447351 | hCV27965689 | rs4753072 | 0.51 | 0.9 | 1 |
| hCV8369472 | rs1447351 | hCV29662341 | rs6483213 | 0.51 | 0.9 | 0.9643 |
| hCV8369472 | rs1447351 | hCV3256840 | rs9666752 | 0.51 | 0.9 | 0.9649 |
| hCV8369472 | rs1447351 | hCV3256848 | rs1447352 | 0.51 | 0.9 | 1 |
| hCV8369472 | rs1447351 | hCV3256849 | rs1597023 | 0.51 | 0.9 | 0.963 |
| hCV8369472 | rs1447351 | hCV3256853 | rs4611171 | 0.51 | 0.9 | 0.963 |
| hCV8369472 | rs1447351 | hCV8369473 | rs1447350 | 0.51 | 0.9 | 1 |
| hCV8369472 | rs1447351 | hCV8369474 | rs1562444 | 0.51 | 0.9 | 0.9813 |
| hCV8379452 | rs4908781 | hCV11675982 | rs1953827 | 0.51 | 0.494607042 | 0.4974 |
| hCV8379452 | rs4908781 | hCV11675985 | rs12136766 | 0.51 | 0.494607042 | 0.4974 |
| hCV8379452 | rs4908781 | hCV1188706 | rs2185205 | 0.51 | 0.494607042 | 0.8302 |
| hCV8379452 | rs4908781 | hCV1188726 | rs6698830 | 0.51 | 0.494607042 | 0.7147 |
| hCV8379452 | rs4908781 | hCV1188747 | rs4908511 | 0.51 | 0.494607042 | 0.7134 |
| hCV8379452 | rs4908781 | hCV1188748 | rs12028160 | 0.51 | 0.494607042 | 0.7134 |
| hCV8379452 | rs4908781 | hCV1265858 | rs11121194 | 0.51 | 0.494607042 | 0.4974 |
| hCV8379452 | rs4908781 | hCV27157851 | rs4480384 | 0.51 | 0.494607042 | 0.5249 |
| hCV8379452 | rs4908781 | hCV29368911 | rs6577513 | 0.51 | 0.494607042 | 0.5458 |
| hCV8379452 | rs4908781 | hCV29855298 | rs6690928 | 0.51 | 0.494607042 | 0.7355 |
| hCV8379452 | rs4908781 | hCV29981708 | rs7554486 | 0.51 | 0.494607042 | 0.5371 |
| hCV8379452 | rs4908781 | hCV30233466 | rs7513880 | 0.51 | 0.494607042 | 0.7147 |
| hCV8379452 | rs4908781 | hCV30413939 | rs6701331 | 0.51 | 0.494607042 | 0.4974 |
| hCV8379452 | rs4908781 | hCV30413946 | rs7537982 | 0.51 | 0.494607042 | 0.5249 |
| hCV8379452 | rs4908781 | hCV3086941 | rs7556169 | 0.51 | 0.494607042 | 0.526 |
| hCV8379452 | rs4908781 | hCV3086945 | rs6695867 | 0.51 | 0.494607042 | 0.5543 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV8379452 | rs4908781 | hCV3086948 | rs10864361 | 0.51 | 0.494607042 | 0.5552 |
| hCV8379452 | rs4908781 | hCV3086949 | rs11121212 | 0.51 | 0.494607042 | 0.5342 |
| hCV8379452 | rs4908781 | hCV3086954 | rs1463053 | 0.51 | 0.494607042 | 0.526 |
| hCV8379452 | rs4908781 | hCV3086956 | rs1463052 | 0.51 | 0.494607042 | 0.4974 |
| hCV8379452 | rs4908781 | hCV3086959 | rs7520025 | 0.51 | 0.494607042 | 0.5204 |
| hCV8379452 | rs4908781 | hCV3086974 | rs1318218 | 0.51 | 0.494607042 | 0.5323 |
| hCV8379452 | rs4908781 | hCV3086976 | rs11121204 | 0.51 | 0.494607042 | 0.5249 |
| hCV8379452 | rs4908781 | hCV32055489 | rs10864360 | 0.51 | 0.494607042 | 0.5342 |
| hCV8379452 | rs4908781 | hCV32055498 | rs4908507 | 0.51 | 0.494607042 | 0.5543 |
| hCV8379452 | rs4908781 | hCV32055554 | rs12024032 | 0.51 | 0.494607042 | 0.7134 |
| hCV8379452 | rs4908781 | hCV32055587 | rs10864367 | 0.51 | 0.494607042 | 0.7147 |
| hCV8379452 | rs4908781 | hCV32055630 | rs4908518 | 0.51 | 0.494607042 | 0.8302 |
| hCV8379452 | rs4908781 | hCV32392515 | rs4908505 | 0.51 | 0.494607042 | 0.5552 |
| hCV8379452 | rs4908781 | hCV75072264 | rs12403640 | 0.51 | 0.494607042 | 0.6803 |
| hCV8379452 | rs4908781 | hCV77058075 | rs4908506 | 0.51 | 0.494607042 | 0.526 |
| hCV8420416 | rs719909 | hCV29251974 | rs7905163 | 0.51 | 0.9 | 1 |
| hCV8420416 | rs719909 | hCV31659989 | rs11185804 | 0.51 | 0.9 | 1 |
| hCV8420416 | rs719909 | hCV31659993 | rs11185799 | 0.51 | 0.9 | 1 |
| hCV8420416 | rs719909 | hCV31659999 | rs11185793 | 0.51 | 0.9 | 1 |
| hCV8420416 | rs719909 | hCV31660000 | rs11185792 | 0.51 | 0.9 | 1 |
| hCV8420416 | rs719909 | hCV31660001 | rs11185791 | 0.51 | 0.9 | 1 |
| hCV8420416 | rs719909 | hCV31660002 | rs10881610 | 0.51 | 0.9 | 1 |
| hCV8420416 | rs719909 | hCV31660004 | rs10881608 | 0.51 | 0.9 | 1 |
| hCV8420416 | rs719909 | hCV31660007 | rs11185790 | 0.51 | 0.9 | 1 |
| hCV8420416 | rs719909 | hCV31660048 | rs12777243 | 0.51 | 0.9 | 1 |
| hCV8420416 | rs719909 | hCV8420325 | rs11185780 | 0.51 | 0.9 | 1 |
| hCV8420416 | rs719909 | hCV8420398 | rs11185773 | 0.51 | 0.9 | 1 |
| hCV8420416 | rs719909 | hCV8870224 | rs1075374 | 0.51 | 0.9 | 1 |
| hCV8708473 | rs1800469 | hCV11464030 | rs1982072 | 0.51 | 0.9 | 1 |
| hCV8708473 | rs1800469 | hCV15873885 | rs2241714 | 0.51 | 0.9 | 0.9776 |
| hCV8708473 | rs1800469 | hCV15873886 | rs2241715 | 0.51 | 0.9 | 0.9774 |
| hCV8708473 | rs1800469 | hCV16193065 | rs2317130 | 0.51 | 0.9 | 1 |
| hCV8709053 | rs4880 | hCV1362043 | rs2842960 | 0.51 | 0.9 | 1 |
| hCV8709053 | rs4880 | hCV1362077 | rs2842991 | 0.51 | 0.9 | 0.9625 |
| hCV8709053 | rs4880 | hCV1362081 | rs2758319 | 0.51 | 0.9 | 0.9293 |
| hCV8709053 | rs4880 | hCV16072287 | rs2855116 | 0.51 | 0.9 | 0.9625 |
| hCV8709053 | rs4880 | hCV16288770 | rs2758331 | 0.51 | 0.9 | 0.9625 |
| hCV8709053 | rs4880 | hCV27040091 | rs2842989 | 0.51 | 0.9 | 0.9625 |
| hCV8709053 | rs4880 | hCV8709029 | rs8031 | 0.51 | 0.9 | 0.9625 |
| hCV8718197 | rs1050998 | hCV15885167 | rs2277680 | 0.51 | 0.9 | 1 |
| hCV8718197 | rs1050998 | hCV31086637 | rs8071612 | 0.51 | 0.9 | 1 |
| hCV8718197 | rs1050998 | hCV31086638 | rs8073062 | 0.51 | 9 | 1 |
| hCV8726337 | rs5498 | hCV16044655 | rs2075741 | 0.51 | 0.9 | 0.9256 |
| hCV8726337 | rs5498 | hCV1844464 | rs885743 | 0.51 | 0.9 | 0.9604 |
| hCV8726337 | rs5498 | hCV27478391 | rs3093030 | 0.51 | 0.9 | 0.9217 |
| hCV8726337 | rs5498 | hCV31765037 | rs12150978 | 0.51 | 0.9 | 0.9221 |
| hCV8737990 | rs419598 | hCV11948077 | rs16065 | 0.51 | 0.9 | 0.9557 |
| hCV8737990 | rs419598 | hCV11948080 | rs451578 | 0.51 | 0.9 | 1 |
| hCV8737990 | rs419598 | hCV11948081 | rs432014 | 0.51 | 0.9 | 1 |
| hCV8737990 | rs419598 | hCV3133511 | rs4251984 | 0.51 | 0.9 | 0.9557 |
| hCV8737990 | rs419598 | hCV3133512 | rs4251985 | 0.51 | 0.9 | 0.9557 |
| hCV8737990 | rs419598 | hCV3133519 | rs2853628 | 0.51 | 0.9 | 0.9432 |
| hCV8737990 | rs419598 | hCV32060324 | rs4251967 | 0.51 | 0.9 | 1 |
| hCV8737990 | rs419598 | hCV3252471 | rs444413 | 0.51 | 0.9 | 1 |
| hCV8737990 | rs419598 | hCV3252474 | rs1794067 | 0.51 | 0.9 | 1 |
| hCV8737990 | rs419598 | hCV3252475 | rs1794068 | 0.51 | 0.9 | 1 |
| hCV8737990 | rs419598 | hCV8737960 | rs440286 | 0.51 | 0.9 | 0.9537 |
| hCV8737990 | rs419598 | hCV8737965 | rs431726 | 0.51 | 0.9 | 0.9547 |
| hCV8737990 | rs419598 | hCV8737970 | rs454078 | 0.51 | 0.9 | 1 |
| hCV8737990 | rs419598 | hCV8737973 | rs128964 | 0.51 | 0.9 | 1 |
| hCV8737990 | rs419598 | hCV8737974 | rs447713 | 0.51 | 0.9 | 1 |
| hCV8737990 | rs419598 | hCV8737978 | rs408392 | 0.51 | 0.9 | 1 |
| hCV8737990 | rs419598 | hCV8737979 | rs442710 | 0.51 | 0.9 | 1 |
| hCV8737990 | rs419598 | hCV8737980 | rs495410 | 0.51 | 0.9 | 1 |
| hCV8737990 | rs419598 | hCV8737984 | rs495282 | 0.51 | 0.9 | 1 |
| hCV8737990 | rs419598 | hCV8737985 | rs446433 | 0.51 | 0.9 | 1 |
| hCV8737990 | rs419598 | hCV8737986 | rs423904 | 0.51 | 0.9 | 1 |
| hCV8737990 | rs419598 | hCV948686 | rs315936 | 0.51 | 0.9 | 1 |
| hCV8737990 | rs419598 | hDV76981932 | rs4251970 | 0.51 | 0.9 | 0.9556 |
| hCV8784787 | rs688976 | hCV12020218 | rs613423 | 0.51 | 0.9 | 1 |
| hCV8784787 | rs688976 | hCV12020219 | rs624601 | 0.51 | 0.9 | 1 |
| hCV8784787 | rs688976 | hCV16163350 | rs2073825 | 0.51 | 0.9 | 1 |
| hCV8784787 | rs688976 | hCV25610774 | rs8176748 | 0.51 | 0.9 | 1 |
| hCV8784787 | rs688976 | hCV25610819 | rs8176740 | 0.51 | 0.9 | 1 |
| hCV8784787 | rs688976 | hCV25610830 | rs8176717 | 0.51 | 0.9 | 1 |
| hCV8784787 | rs688976 | hCV25610847 | rs8176714 | 0.51 | 0.9 | 1 |
| hCV8784787 | rs688976 | hCV26744836 | rs500428 | 0.51 | 0.9 | 0.9766 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV8784787 | rs688976 | hCV26744838 | rs502361 | 0.51 | 0.9 | 1 |
| hCV8784787 | rs688976 | hCV29669589 | rs8176732 | 0.51 | 0.9 | 1 |
| hCV8784787 | rs688976 | hCV30120679 | rs8176728 | 0.51 | 0.9 | 1 |
| hCV8784787 | rs688976 | hCV30192755 | rs568203 | 0.51 | 0.9 | 1 |
| hCV8784787 | rs688976 | hCV30534973 | rs626035 | 0.51 | 0.9 | 1 |
| hCV8784787 | rs688976 | hCV30661132 | rs11244053 | 0.51 | 0.9 | 1 |
| hCV8784787 | rs688976 | hCV3183108 | rs474279 | 0.51 | 0.9 | 1 |
| hCV8784787 | rs688976 | hCV3183120 | rs574311 | 0.51 | 0.9 | 1 |
| hCV8784787 | rs688976 | hCV8784788 | rs493211 | 0.51 | 0.9 | 0.9497 |
| hCV8784787 | rs688976 | hCV997885 | rs641959 | 0.51 | 0.9 | 0.9129 |
| hCV8784787 | rs688976 | hCV997886 | rs641943 | 0.51 | 0.9 | 0.9541 |
| hCV8784787 | rs688976 | hCV997887 | rs514708 | 0.51 | 0.9 | 0.9541 |
| hCV8784787 | rs688976 | hCV997888 | rs517414 | 0.51 | 0.9 | 1 |
| hCV8784787 | rs688976 | hCV997889 | rs638756 | 0.51 | 0.9 | 0.9503 |
| hCV8784787 | rs688976 | hCV997893 | rs547643 | 0.51 | 0.9 | 1 |
| hCV8784787 | rs688976 | hCV997897 | rs549446 | 0.51 | 0.9 | 1 |
| hCV8784787 | rs688976 | hCV997902 | rs574347 | 0.51 | 0.9 | 1 |
| hCV8784787 | rs688976 | hCV997904 | rs579483 | 0.51 | 0.9 | 1 |
| hCV8784787 | rs688976 | hCV997905 | rs579622 | 0.51 | 0.9 | 1 |
| hCV8784787 | rs688976 | hCV997906 | rs672316 | 0.51 | 0.9 | 0.9541 |
| hCV8784787 | rs688976 | hCV997925 | rs552148 | 0.51 | 0.9 | 0.9767 |
| hCV8784787 | rs688976 | hDV77084283 | rs549331 | 0.51 | 0.9 | 1 |
| hCV8784787 | rs688976 | hDV81175228 | rs625593 | 0.51 | 0.9 | 1 |
| hCV8785824 | rs1412426 | hCV11841945 | rs10815370 | 0.51 | 0.9 | 0.93 |
| hCV8785824 | rs1412426 | hCV12096524 | rs1929996 | 0.51 | 0.9 | 1 |
| hCV8785824 | rs1412426 | hCV2762174 | rs4742167 | 0.51 | 0.9 | 0.93 |
| hCV8785824 | rs1412426 | hCV31940475 | rs4742166 | 0.51 | 0.9 | 1 |
| hCV8785824 | rs1412426 | hCV8785825 | rs1412425 | 0.51 | 0.9 | 1 |
| hCV8785827 | rs992969 | hCV12096527 | rs1888909 | 0.51 | 0.9 | 0.9767 |
| hCV8785827 | rs992969 | hCV12096531 | rs928413 | 0.51 | 0.9 | 0.9767 |
| hCV8785827 | rs992969 | hCV16108911 | rs2095044 | 0.51 | 0.9 | 0.9616 |
| hCV8785827 | rs992969 | hCV16225421 | rs2381416 | 0.51 | 0.9 | 0.9252 |
| hCV8785827 | rs992969 | hCV2762168 | rs3939286 | 0.51 | 0.9 | 1 |
| hCV8785827 | rs992969 | hCV31940459 | rs7848215 | 0.51 | 0.9 | 0.9252 |
| hCV8804621 | rs1390938 | hCV16135403 | rs2132699 | 0.51 | 0.9 | 1 |
| hCV8804621 | rs1390938 | hCV2716010 | rs6586898 | 0.51 | 0.9 | 0.9759 |
| hCV8804621 | rs1390938 | hCV27964220 | rs4921694 | 0.51 | 0.9 | 1 |
| hCV8804621 | rs1390938 | hCV29049483 | rs6992927 | 0.51 | 0.9 | 1 |
| hCV8804621 | rs1390938 | hCV30973375 | rs7006986 | 0.51 | 0.9 | 1 |
| hCV8804621 | rs1390938 | hCV8804610 | rs952859 | 0.51 | 0.9 | 1 |
| hCV8804621 | rs1390938 | hCV8804615 | rs952858 | 0.51 | 0.9 | 1 |
| hCV8804621 | rs1390938 | hCV8804626 | rs988713 | 0.51 | 0.9 | 0.9756 |
| hCV8823713 | rs1472228 | hCV1188731 | rs4908514 | 0.51 | 0.900026297 | 1 |
| hCV8823713 | rs1472228 | hCV1188735 | rs10864366 | 0.51 | 0.900026297 | 1 |
| hCV8823713 | rs1472228 | hCV27157507 | rs6664000 | 0.51 | 0.900026297 | 1 |
| hCV8823713 | rs1472228 | hCV27157524 | rs6577531 | 0.51 | 0.900026297 | 0.9314 |
| hCV8823713 | rs1472228 | hCV27884601 | rs4908776 | 0.51 | 0.900026297 | 1 |
| hCV8823713 | rs1472228 | hCV28023091 | rs4908773 | 0.51 | 0.900026297 | 1 |
| hCV8823713 | rs1472228 | hCV29368919 | rs4908513 | 0.51 | 0.900026297 | 1 |
| hCV8823713 | rs1472228 | hCV29873524 | rs7533113 | 0.51 | 0.900026297 | 1 |
| hCV8823713 | rs1472228 | hCV29945430 | rs7517436 | 0.51 | 0.900026297 | 1 |
| hCV8823713 | rs1472228 | hCV30035535 | rs7518204 | 0.51 | 0.900026297 | 1 |
| hCV8823713 | rs1472228 | hCV32055527 | rs10864364 | 0.51 | 0.900026297 | 1 |
| hCV8823713 | rs1472228 | hCV32055579 | rs6577522 | 0.51 | 0.900026297 | 1 |
| hCV8823713 | rs1472228 | hCV32055595 | rs6577524 | 0.51 | 0.900026297 | 1 |
| hCV8823713 | rs1472228 | hCV32055596 | rs6577525 | 0.51 | 0.900026297 | 1 |
| hCV8824248 | rs1543711 | hCV1188659 | rs3820037 | 0.51 | 0.867554387 | 1 |
| hCV8824248 | rs1543711 | hCV1188660 | rs6660137 | 0.51 | 0.867554387 | 1 |
| hCV8824248 | rs1543711 | hCV1188664 | rs2765511 | 0.51 | 0.867554387 | 1 |
| hCV8824248 | rs1543711 | hCV1188665 | rs2781060 | 0.51 | 0.867554387 | 1 |
| hCV8824248 | rs1543711 | hCV1188676 | rs11121247 | 0.51 | 0.867554387 | 1 |
| hCV8824248 | rs1543711 | hCV12040675 | rs2038904 | 0.51 | 0.867554387 | 1 |
| hCV8824248 | rs1543711 | hCV15932991 | rs2781067 | 0.51 | 0.867554387 | 1 |
| hCV8824248 | rs1543711 | hCV15932992 | rs2781068 | 0.51 | 0.867554387 | 1 |
| hCV8824248 | rs1543711 | hCV27157546 | rs11811795 | 0.51 | 0.867554387 | 0.942 |
| hCV8824248 | rs1543711 | hCV8824241 | rs1325920 | 0.51 | 0.867554387 | 0.9416 |
| hCV8824248 | rs1543711 | hCV8824244 | rs1006950 | 0.51 | 0.867554387 | 1 |
| hCV8824394 | rs1443929 | hCV15882429 | rs2289732 | 0.51 | 0.868495377 | 1 |
| hCV8824394 | rs1443929 | hCV2741759 | rs11121179 | 0.51 | 0.868495377 | 1 |
| hCV8824394 | rs1443929 | hCV27474399 | rs3753275 | 0.51 | 0.868495377 | 0.8913 |
| hCV8824394 | rs1443929 | hCV2943451 | rs902355 | 0.51 | 0.868495377 | 0.9232 |
| hCV8824394 | rs1443929 | hCV2943853 | rs301793 | 0.51 | 0.868495377 | 1 |
| hCV8824394 | rs1443929 | hCV2966436 | rs11121174 | 0.51 | 0.868495377 | 1 |
| hCV8824394 | rs1443929 | hCV2966437 | rs11580417 | 0.51 | 0.868495377 | 1 |
| hCV8824394 | rs1443929 | hCV2966441 | rs6684863 | 0.51 | 0.868495377 | 1 |
| hCV8824394 | rs1443929 | hCV2966444 | rs11121171 | 0.51 | 0.868495377 | 0.9345 |
| hCV8824394 | rs1443929 | hCV32055284 | rs12079653 | 0.51 | 0.868495377 | 0.9336 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hCV8824394 | rs1443929 | hCV529182 | rs301800 | 0.51 | 0.868495377 | 0.9634 |
| hCV8824394 | rs1443929 | hCV877241 | rs301788 | 0.51 | 0.868495377 | 1 |
| hCV8824394 | rs1443929 | hCV8824424 | rs1058790 | 0.51 | 0.868495377 | 0.9345 |
| hCV8824394 | rs1443929 | hCV8824425 | rs1058791 | 0.51 | 0.868495377 | 0.8913 |
| hCV8824424 | rs1058790 | hCV15882429 | rs2289732 | 0.51 | 0.899566528 | 0.9381 |
| hCV8824424 | rs1058790 | hCV2741759 | rs11121179 | 0.51 | 0.899566528 | 0.9345 |
| hCV8824424 | rs1058790 | hCV2943451 | rs902355 | 0.51 | 0.899566528 | 0.928 |
| hCV8824424 | rs1058790 | hCV2943853 | rs301793 | 0.51 | 0.899566528 | 0.9381 |
| hCV8824424 | rs1058790 | hCV2966436 | rs11121174 | 0.51 | 0.899566528 | 0.9381 |
| hCV8824424 | rs1058790 | hCV2966437 | rs11580417 | 0.51 | 0.899566528 | 0.9381 |
| hCV8824424 | rs1058790 | hCV2966441 | rs6684863 | 0.51 | 0.899566528 | 0.9381 |
| hCV8824424 | rs1058790 | hCV2966444 | rs11121171 | 0.51 | 0.899566528 | 1 |
| hCV8824424 | rs1058790 | hCV877241 | rs301788 | 0.51 | 0.899566528 | 0.9345 |
| hCV8824424 | rs1058790 | hCV8824394 | rs1443929 | 0.51 | 0.899566528 | 0.9345 |
| hCV8824424 | rs1058790 | hCV8824425 | rs1058791 | 0.51 | 0.899566528 | 1 |
| hCV8824425 | rs1058791 | hCV15882429 | rs2289732 | 0.51 | 0.90786153 | 0.9345 |
| hCV8824425 | rs1058791 | hCV2943451 | rs902355 | 0.51 | 0.90786153 | 0.9232 |
| hCV8824425 | rs1058791 | hCV2943853 | rs301793 | 0.51 | 0.90786153 | 0.9345 |
| hCV8824425 | rs1058791 | hCV2966436 | rs11121174 | 0.51 | 0.90786153 | 09345 |
| hCV8824425 | rs1058791 | hCV2966437 | rs11580417 | 0.51 | 0.90786153 | 0.9345 |
| hCV8824425 | rs1058791 | hCV2966441 | rs6684863 | 0.51 | 0.90786153 | 0.9345 |
| hCV8824425 | rs1058791 | hCV2966444 | rs11121171 | 0.51 | 0.90786153 | 1 |
| hCV8824425 | rs1058791 | hCV8824424 | rs1058790 | 0.51 | 0.90786153 | 1 |
| hCV8824453 | rs1466654 | hCV27157329 | rs7517675 | 0.51 | 0.800819542 | 0.9628 |
| hCV8848630 | rs7192 | hCV11409962 | rs2213586 | 0.51 | 0.9 | 1 |
| hCV8848630 | rs7192 | hCV11409963 | rs2213585 | 0.51 | 0.9 | 1 |
| hCV8848630 | rs7192 | hCV15954888 | rs2227139 | 0.51 | 0.9 | 1 |
| hCV8848630 | rs7192 | hCV27497869 | rs3763327 | 0.51 | 0.9 | 1 |
| hCV8848630 | rs7192 | hCV29745141 | rs9268832 | 0.51 | 0.9 | 0.9373 |
| hCV8848630 | rs7192 | hCV29839151 | rs7754768 | 0.51 | 0.9 | 0.9586 |
| hCV8848630 | rs7192 | hCV8848631 | rs7194 | 0.51 | 0.9 | 1 |
| hCV8848630 | rs7192 | hCV8848636 | rs7195 | 0.51 | 0.9 | 1 |
| hCV8881161 | rs926951 | hCV27958354 | rs4908762 | 0.51 | 0.970327874 | 1 |
| hCV8881161 | rs926951 | hCV29873526 | rs6697997 | 0.51 | 0.970327874 | 1 |
| hCV8881161 | rs926951 | hCV3086998 | rs7530863 | 0.51 | 0.970327874 | 1 |
| hCV8881161 | rs926951 | hCV3087000 | rs1463055 | 0.51 | 0.970327874 | 1 |
| hCV8881161 | rs926951 | hCV3087003 | rs6577500 | 0.51 | 0.970327874 | 1 |
| hCV8881161 | rs926951 | hCV3087015 | rs11121198 | 0.51 | 0.970327874 | 1 |
| hCV8881161 | rs926951 | hCV32055548 | rs11121197 | 0.51 | 0.970327874 | 1 |
| hCV8881161 | rs926951 | hCV32055677 | rs10864355 | 0.51 | 0.970327874 | 1 |
| hCV8881161 | rs926951 | hCV529178 | rs301811 | 0.51 | 0.970327874 | 1 |
| hCV8881161 | rs926951 | hCV597227 | rs301809 | 0.51 | 0.970327874 | 1 |
| hCV8881161 | rs926951 | hCV597229 | rs301785 | 0.51 | 0.970327874 | 1 |
| hCV8881161 | rs926951 | hCV8824288 | rs910582 | 0.51 | 0.970327874 | 1 |
| hCV8892418 | rs901746 | hCV11666937 | rs7395581 | 0.51 | 0.9 | 0.9122 |
| hCV8892418 | rs901746 | hCV1301028 | rs830085 | 0.51 | 0.9 | 0.978 |
| hCV8892418 | rs901746 | hCV1301036 | rs326222 | 0.51 | 0.9 | 1 |
| hCV8892418 | rs901746 | hCV1301048 | rs2167079 | 0.51 | 0.9 | 1 |
| hCV8892418 | rs901746 | hCV1301060 | rs7120118 | 0.51 | 0.9 | 1 |
| hCV8892418 | rs901746 | hCV1301081 | rs7124955 | 0.51 | 0.9 | 0.9115 |
| hCV8892418 | rs901746 | hCV1301085 | rs1375688 | 0.51 | 0.9 | 0.907 |
| hCV8892418 | rs901746 | hCV1301094 | rs10838692 | 0.51 | 0.9 | 0.9566 |
| hCV8892418 | rs901746 | hCV22275070 | rs3816725 | 0.51 | 0.9 | 0.9566 |
| hCV8892418 | rs901746 | hCV27477935 | rs3758673 | 0.51 | 0.9 | 0.9776 |
| hCV8892418 | rs901746 | hCV27484275 | rs3781622 | 0.51 | 0.9 | 0.907 |
| hCV8892418 | rs901746 | hCV30887885 | rs11039166 | 0.51 | 0.9 | 0.907 |
| hCV8892418 | rs901746 | hCV30887894 | rs4752824 | 0.51 | 0.9 | 0.9359 |
| hCV8892418 | rs901746 | hCV607862 | rs326214 | 0.51 | 0.9 | 0.9566 |
| hCV8892418 | rs901746 | hCV8890616 | rs1052373 | 0.51 | 0.9 | 0.9566 |
| hCV8892418 | rs901746 | hCV8892417 | rs2013867 | 0.51 | 0.9 | 1 |
| hCV8892418 | rs901746 | hCV8892456 | rs1449627 | 0.51 | 0.9 | 0.9566 |
| hCV8892418 | rs901746 | hCV8892463 | rs3847502 | 0.51 | 0.9 | 0.9157 |
| hCV8895373 | rs1503185 | hCV11665699 | rs11039528 | 0.51 | 0.9 | 1 |
| hCV8895373 | rs1503185 | hCV11665715 | rs11039522 | 0.51 | 0.9 | 0.9186 |
| hCV8895373 | rs1503185 | hCV11665751 | rs12576134 | 0.51 | 0.9 | 0.9133 |
| hCV8895373 | rs1503185 | hCV142450 | rs11607114 | 0.51 | 0.9 | 1 |
| hCV8895373 | rs1503185 | hCV288149 | rs1566734 | 0.51 | 0.9 | 0.9564 |
| hCV8895373 | rs1503185 | hCV31699609 | rs12577284 | 0.51 | 0.9 | 0.9563 |
| hCV8895373 | rs1503185 | hCV31699653 | rs11599936 | 0.51 | 0.9 | 0.9236 |
| hCV8895373 | rs1503185 | hCV440189 | rs11600061 | 0.51 | 0.9 | 0.9278 |
| hCV8895373 | rs1503185 | hCV8895366 | rs905476 | 0.51 | 0.9 | 0.9564 |
| hCV8901525 | rs861539 | hCV16012197 | rs2403205 | 0.51 | 0.9 | 0.9808 |
| hCV8901525 | rs861539 | hCV2169415 | rs7150141 | 0.51 | 0.9 | 0.9808 |
| hCV8901525 | rs861539 | hCV25800743 | rs3783404 | 0.51 | 0.9 | 0.9637 |
| hCV8901525 | rs861539 | hCV29700968 | rs10135248 | 0.51 | 0.9 | 0.9808 |
| hCV8901525 | rs861539 | hCV2983915 | rs861534 | 0.51 | 0.9 | 0.9581 |
| hCV8901525 | rs861539 | hCV30187701 | rs10134399 | 0.51 | 0.9 | 0.9051 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV8901525 | rs861539 | hCV8901478 | rs709400 | 0.51 | 0.9 | 0.9808 |
| hCV8901525 | rs861539 | hCV8901529 | rs861536 | 0.51 | 0.9 | 0.9806 |
| hCV8901525 | rs861539 | hCV8901543 | rs861531 | 0.51 | 0.9 | 0.9808 |
| hCV904974 | rs439401 | hCV8711653 | rs584007 | 0.51 | 0.729367768 | 0.9603 |
| hCV904974 | rs439401 | hCV8711653 | rs584007 | 0.51 | 0.9 | 0.9603 |
| hCV922535 | rs748065 | hCV29043517 | rs7014068 | 0.51 | 0.9 | 1 |
| hCV922535 | rs748065 | hCV29681450 | rs4872494 | 0.51 | 0.9 | 0.9628 |
| hCV922535 | rs748065 | hCV30510401 | rs10107278 | 0.51 | 0.9 | 1 |
| hCV922535 | rs748065 | hDV70839295 | rs17060585 | 0.51 | 0.9 | 1 |
| hCV9506149 | rs1250259 | hCV11734951 | rs1250247 | 0.51 | 0.9 | 0.955 |
| hCV9506149 | rs1250259 | hCV2110731 | rs1250248 | 0.51 | 0.9 | 0.9505 |
| hCV9506149 | rs1250259 | hCV2110747 | rs1250258 | 0.51 | 0.9 | 1 |
| hCV9506149 | rs1250259 | hCV2110751 | rs1250229 | 0.51 | 0.9 | 0.9111 |
| hCV9506149 | rs1250259 | hCV8838302 | rs1250241 | 0.51 | 0.9 | 0.955 |
| hCV9506149 | rs1250259 | hCV8838303 | rs1250240 | 0.51 | 0.9 | 0.955 |
| hCV9506149 | rs1250259 | hCV9506150 | rs1250242 | 0.51 | 0.9 | 0.955 |
| hCV9581635 | rs1748195 | hCV11864156 | rs10889334 | 0.51 | 0.9 | 0.9583 |
| hCV9581635 | rs1748195 | hCV11864162 | rs1167998 | 0.51 | 0.9 | 0.9791 |
| hCV9581635 | rs1748195 | hCV11865171 | rs11208004 | 0.51 | 0.9 | 0.979 |
| hCV9581635 | rs1748195 | hCV11865185 | rs10789117 | 0.51 | 0.9 | 1 |
| hCV9581635 | rs1748195 | hCV11865196 | rs7555577 | 0.51 | 0.9 | 0.919 |
| hCV9581635 | rs1748195 | hCV11865201 | rs10159255 | 0.51 | 0.9 | 0.958 |
| hCV9581635 | rs1748195 | hCV12103105 | rs1184865 | 0.51 | 0.9 | 0.9791 |
| hCV9581635 | rs1748195 | hCV12103127 | rs1979722 | 0.51 | 0.9 | 0.9578 |
| hCV9581635 | rs1748195 | hCV12103499 | rs2029763 | 0.51 | 0.9 | 0.9558 |
| hCV9581635 | rs1748195 | hCV12103502 | rs1168023 | 0.51 | 0.9 | 1 |
| hCV9581635 | rs1748195 | hCV1236535 | rs1168042 | 0.51 | 0.9 | 1 |
| hCV9581635 | rs1748195 | hCV149783 | rs1168045 | 0.51 | 0.9 | 1 |
| hCV9581635 | rs1748195 | hCV16214290 | rs2366638 | 0.51 | 0.9 | 1 |
| hCV9581635 | rs1748195 | hCV1778957 | rs3913007 | 0.51 | 0.9 | 0.979 |
| hCV9581635 | rs1748195 | hCV1778958 | rs634341 | 0.51 | 0.9 | 1 |
| hCV9581635 | rs1748195 | hCV1778961 | rs630144 | 0.51 | 0.9 | 0.9164 |
| hCV9581635 | rs1748195 | hCV1778963 | rs10158897 | 0.51 | 0.9 | 0.958 |
| hCV9581635 | rs1748195 | hCV1778964 | rs659656 | 0.51 | 0.9 | 0.959 |
| hCV9581635 | rs1748195 | hCV1778965 | rs637723 | 0.51 | 0.9 | 0.9791 |
| hCV9581635 | rs1748195 | hCV1918028 | rs10157265 | 0.51 | 0.9 | 1 |
| hCV9581635 | rs1748195 | hCV1918041 | rs4587594 | 0.51 | 0.9 | 0.979 |
| hCV9581635 | rs1748195 | hCV1918054 | rs10889347 | 0.51 | 0.9 | 1 |
| hCV9581635 | rs1748195 | hCV25971202 | rs10889335 | 0.51 | 0.9 | 0.9376 |
| hCV9581635 | rs1748195 | hCV26412183 | rs1748199 | 0.51 | 0.9 | 0.979 |
| hCV9581635 | rs1748195 | hCV26412184 | rs11207990 | 0.51 | 0.9 | 1 |
| hCV9581635 | rs1748195 | hCV27320451 | rs4350231 | 0.51 | 0.9 | 0.958 |
| hCV9581635 | rs1748195 | hCV27320465 | rs641540 | 0.51 | 0.9 | 1 |
| hCV9581635 | rs1748195 | hCV29103721 | rs6678483 | 0.51 | 0.9 | 1 |
| hCV9581635 | rs1748195 | hCV29103722 | rs6675401 | 0.51 | 0.9 | 1 |
| hCV9581635 | rs1748195 | hCV29103723 | rs4329540 | 0.51 | 0.9 | 1 |
| hCV9581635 | rs1748195 | hCV29647381 | rs6690733 | 0.51 | 0.9 | 0.9791 |
| hCV9581635 | rs1748195 | hCV29749081 | rs10493322 | 0.51 | 0.9 | 0.959 |
| hCV9581635 | rs1748195 | hCV30224093 | rs7539035 | 0.51 | 0.9 | 1 |
| hCV9581635 | rs1748195 | hCV31145250 | rs10889353 | 0.51 | 0.9 | 0.979 |
| hCV9581635 | rs1748195 | hCV31145255 | rs11208000 | 0.51 | 0.9 | 0.9777 |
| hCV9581635 | rs1748195 | hCV31145262 | rs10889352 | 0.51 | 0.9 | 0.9539 |
| hCV9581635 | rs1748195 | hCV31145264 | rs10789119 | 0.51 | 0.9 | 0.979 |
| hCV9581635 | rs1748195 | hCV31145266 | rs10789118 | 0.51 | 0.9 | 0.959 |
| hCV9581635 | rs1748195 | hCV31145267 | rs11485618 | 0.51 | 0.9 | 0.9576 |
| hCV9581635 | rs1748195 | hCV31145269 | rs6587980 | 0.51 | 0.9 | 1 |
| hCV9581635 | rs1748195 | hCV31145277 | rs10889350 | 0.51 | 0.9 | 1 |
| hCV9581635 | rs1748195 | hCV31145279 | rs10889349 | 0.51 | 0.9 | 1 |
| hCV9581635 | rs1748195 | hCV31145282 | rs11207997 | 0.51 | 0.9 | 0.9373 |
| hCV9581635 | rs1748195 | hCV31145290 | rs12042319 | 0.51 | 0.9 | 0.959 |
| hCV9581635 | rs1748195 | hCV31145291 | rs11207995 | 0.51 | 0.9 | 0.9578 |
| hCV9581635 | rs1748195 | hCV31145298 | rs11207992 | 0.51 | 0.9 | 0.959 |
| hCV9581635 | rs1748195 | hCV31145302 | rs12116574 | 0.51 | 0.9 | 0.979 |
| hCV9581635 | rs1748195 | hCV31145332 | rs11207981 | 0.51 | 0.9 | 1 |
| hCV9581635 | rs1748195 | hCV3122390 | rs1748200 | 0.51 | 0.9 | 1 |
| hCV9581635 | rs1748195 | hCV316299 | rs1168026 | 0.51 | 0.9 | 1 |
| hCV9581635 | rs1748195 | hCV316303 | rs1168031 | 0.51 | 0.9 | 1 |
| hCV9581635 | rs1748195 | hCV32220452 | rs12090886 | 0.51 | 0.9 | 1 |
| hCV9581635 | rs1748195 | hCV32220453 | rs10889337 | 0.51 | 0.9 | 0.9791 |
| hCV9581635 | rs1748195 | hCV32220467 | rs10889333 | 0.51 | 0.9 | 0.979 |
| hCV9581635 | rs1748195 | hCV32220469 | rs10889332 | 0.51 | 0.9 | 1 |
| hCV9581635 | rs1748195 | hCV32220470 | rs11207974 | 0.51 | 0.9 | 1 |
| hCV9581635 | rs1748195 | hCV32220491 | rs11577840 | 0.51 | 0.9 | 1 |
| hCV9581635 | rs1748195 | hCV32220495 | rs11207969 | 0.51 | 0.9 | 1 |
| hCV9581635 | rs1748195 | hCV408090 | rs1183260 | 0.51 | 0.9 | 1 |
| hCV9581635 | rs1748195 | hCV445207 | rs1627591 | 0.51 | 0.9 | 1 |
| hCV9581635 | rs1748195 | hCV71419 | rs2131925 | 0.51 | 0.9 | 1 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV9581635 | rs1748195 | hCV857102 | rs624660 | 0.51 | 0.9 | 1 |
| hCV9581635 | rs1748195 | hCV857103 | rs636497 | 0.51 | 0.9 | 0.979 |
| hCV9581635 | rs1748195 | hCV857104 | rs636523 | 0.51 | 0.9 | 0.959 |
| hCV9581635 | rs1748195 | hCV857108 | rs597078 | 0.51 | 0.9 | 1 |
| hCV9581635 | rs1748195 | hCV857109 | rs597470 | 0.51 | 0.9 | 1 |
| hCV9581635 | rs1748195 | hCV857110 | rs583609 | 0.51 | 0.9 | 1 |
| hCV9581635 | rs1748195 | hCV857121 | rs642845 | 0.51 | 0.9 | 1 |
| hCV9581635 | rs1748195 | hCV857122 | rs656297 | 0.51 | 0.9 | 1 |
| hCV9581635 | rs1748195 | hCV857123 | rs638305 | 0.51 | 0.9 | 1 |
| hCV9581635 | rs1748195 | hCV857127 | rs631106 | 0.51 | 0.9 | 0.979 |
| hCV9581635 | rs1748195 | hCV9508668 | rs1781195 | 0.51 | 0.9 | 1 |
| hCV9581635 | rs1748195 | hCV9581062 | rs998403 | 0.51 | 0.9 | 0.958 |
| hCV9581635 | rs1748195 | hCV9581551 | rs1168040 | 0.51 | 0.9 | 0.9151 |
| hCV9581635 | rs1748195 | hCV9581570 | rs1168036 | 0.51 | 0.9 | 1 |
| hCV9581635 | rs1748195 | hCV9581571 | rs1002687 | 0.51 | 0.9 | 1 |
| hCV9581635 | rs1748195 | hCV9581580 | rs1168032 | 0.51 | 0.9 | 0.9789 |
| hCV9581635 | rs1748195 | hCV9581581 | rs1168030 | 0.51 | 0.9 | 1 |
| hCV9581635 | rs1748195 | hCV9581590 | rs1168018 | 0.51 | 0.9 | 1 |
| hCV9581635 | rs1748195 | hCV9581606 | rs1168022 | 0.51 | 0.9 | 1 |
| hCV9581635 | rs1748195 | hCV9581615 | rs1748201 | 0.51 | 0.9 | 1 |
| hCV9581635 | rs1748195 | hCV9581636 | rs3850634 | 0.51 | 0.9 | 0.979 |
| hCV9581635 | rs1748195 | hCV9581680 | rs1748197 | 0.51 | 0.9 | 1 |
| hCV9581635 | rs1748195 | hCV9581691 | rs1570694 | 0.51 | 0.9 | 0.979 |
| hCV9581635 | rs1748195 | hCV9583244 | rs783291 | 0.51 | 0.9 | 1 |
| hCV9581635 | rs1748195 | hCV9588770 | rs1007205 | 0.51 | 0.9 | 1 |
| hCV9581635 | rs1748195 | hCV9588793 | rs1168009 | 0.51 | 0.9 | 0.9575 |
| hCV9581635 | rs1748195 | hCV9588794 | rs1168010 | 0.51 | 0.9 | 0.9572 |
| hCV9581635 | rs1748195 | hCV9588829 | rs1781212 | 0.51 | 0.9 | 1 |
| hCV9581635 | rs1748195 | hCV9588850 | rs1168013 | 0.51 | 0.9 | 1 |
| hCV9581635 | rs1748195 | hCV9588862 | rs995000 | 0.51 | 0.9 | 0.979 |
| hCV9581635 | rs1748195 | hCV9588875 | rs1168086 | 0.51 | 0.9 | 0.9551 |
| hCV9581635 | rs1748195 | hCV9588886 | rs1168089 | 0.51 | 0.9 | 1 |
| hCV9581635 | rs1748195 | hCV9588930 | rs1168099 | 0.51 | 0.9 | 1 |
| hCV9581635 | rs1748195 | hCV9588985 | rs1168124 | 0.51 | 0.9 | 1 |
| hCV9581635 | rs1748195 | hDV75176134 | rs1781221 | 0.51 | 0.9 | 1 |
| hCV9588862 | rs995000 | hCV11864156 | rs10889334 | 0.51 | 0.9 | 1 |
| hCV9588862 | rs995000 | hCV11864162 | rs1167998 | 0.51 | 0.9 | 0.9585 |
| hCV9588862 | rs995000 | hCV11865171 | rs11208004 | 0.51 | 0.9 | 1 |
| hCV9588862 | rs995000 | hCV11865185 | rs10789117 | 0.51 | 0.9 | 0.979 |
| hCV9588862 | rs995000 | hCV11865201 | rs10159255 | 0.51 | 0.9 | 0.979 |
| hCV9588862 | rs995000 | hCV12103105 | rs1184865 | 0.51 | 0.9 | 0.9585 |
| hCV9588862 | rs995000 | hCV12103127 | rs1979722 | 0.51 | 0.9 | 0.9789 |
| hCV9588862 | rs995000 | hCV12103499 | rs2029763 | 0.51 | 0.9 | 1 |
| hCV9588862 | rs995000 | hCV12103502 | rs1168023 | 0.51 | 0.9 | 0.958 |
| hCV9588862 | rs995000 | hCV1236535 | rs1168042 | 0.51 | 0.9 | 0.959 |
| hCV9588862 | rs995000 | hCV149783 | rs1168045 | 0.51 | 0.9 | 0.979 |
| hCV9588862 | rs995000 | hCV16214290 | rs2366638 | 0.51 | 0.9 | 0.959 |
| hCV9588862 | rs995000 | hCV1778957 | rs3913007 | 0.51 | 0.9 | 1 |
| hCV9588862 | rs995000 | hCV1778958 | rs634341 | 0.51 | 0.9 | 0.9558 |
| hCV9588862 | rs995000 | hCV1778963 | rs10158897 | 0.51 | 0.9 | 0.979 |
| hCV9588862 | rs995000 | hCV1778964 | rs659656 | 0.51 | 0.9 | 1 |
| hCV9588862 | rs995000 | hCV1778965 | rs637723 | 0.51 | 0.9 | 0.9585 |
| hCV9588862 | rs995000 | hCV1918028 | rs10157265 | 0.51 | 0.9 | 0.958 |
| hCV9588862 | rs995000 | hCV1918041 | rs4587594 | 0.51 | 0.9 | 1 |
| hCV9588862 | rs995000 | hCV1918054 | rs10889347 | 0.51 | 0.9 | 0.979 |
| hCV9588862 | rs995000 | hCV2015148 | rs11208007 | 0.51 | 0.9 | 0.9032 |
| hCV9588862 | rs995000 | hCV25971202 | rs10889335 | 0.51 | 0.9 | 0.9585 |
| hCV9588862 | rs995000 | hCV26412183 | rs1748199 | 0.51 | 0.9 | 0.9577 |
| hCV9588862 | rs995000 | hCV26412184 | rs11207990 | 0.51 | 0.9 | 0.9521 |
| hCV9588862 | rs995000 | hCV27320451 | rs4350231 | 0.51 | 0.9 | 0.979 |
| hCV9588862 | rs995000 | hCV27320465 | rs641540 | 0.51 | 0.9 | 0.9586 |
| hCV9588862 | rs995000 | hCV29103721 | rs6678483 | 0.51 | 0.9 | 0.979 |
| hCV9588862 | rs995000 | hCV29103722 | rs6675401 | 0.51 | 0.9 | 0.979 |
| hCV9588862 | rs995000 | hCV29103723 | rs4329540 | 0.51 | 0.9 | 0.979 |
| hCV9588862 | rs995000 | hCV29647381 | rs6690733 | 0.51 | 0.9 | 0.9585 |
| hCV9588862 | rs995000 | hCV29749081 | rs10493322 | 0.51 | 0.9 | 1 |
| hCV9588862 | rs995000 | hCV30224093 | rs7539035 | 0.51 | 0.9 | 0.979 |
| hCV9588862 | rs995000 | hCV31145250 | rs10889353 | 0.51 | 0.9 | 1 |
| hCV9588862 | rs995000 | hCV31145255 | rs11208000 | 0.51 | 0.9 | 0.9551 |
| hCV9588862 | rs995000 | hCV31145262 | rs10889352 | 0.51 | 0.9 | 1 |
| hCV9588862 | rs995000 | hCV31145264 | rs10789119 | 0.51 | 0.9 | 1 |
| hCV9588862 | rs995000 | hCV31145266 | rs10789118 | 0.51 | 0.9 | 1 |
| hCV9588862 | rs995000 | hCV31145267 | rs11485618 | 0.51 | 0.9 | 1 |
| hCV9588862 | rs995000 | hCV31145269 | rs6587980 | 0.51 | 0.9 | 0.979 |
| hCV9588862 | rs995000 | hCV31145277 | rs10889350 | 0.51 | 0.9 | 0.959 |
| hCV9588862 | rs995000 | hCV31145279 | rs10889349 | 0.51 | 0.9 | 0.959 |
| hCV9588862 | rs995000 | hCV31145282 | rs11207997 | 0.51 | 0.9 | 0.9169 |

TABLE 6-continued

| Interrogated SNP (hCV #) | Interrogated SNP (rs #) | LD SNP (hCV #) | LD SNP (rs #) | Power | Threshold $r^2$ | $r^2$ |
|---|---|---|---|---|---|---|
| hCV9588862 | rs995000 | hCV31145290 | rs12042319 | 0.51 | 0.9 | 1 |
| hCV9588862 | rs995000 | hCV31145291 | rs11207995 | 0.51 | 0.9 | 0.9789 |
| hCV9588862 | rs995000 | hCV31145298 | rs11207992 | 0.51 | 0.9 | 1 |
| hCV9588862 | rs995000 | hCV31145302 | rs12116574 | 0.51 | 0.9 | 1 |
| hCV9588862 | rs995000 | hCV31145332 | rs11207981 | 0.51 | 0.9 | 0.9538 |
| hCV9588862 | rs995000 | hCV3122390 | rs1748200 | 0.51 | 0.9 | 0.959 |
| hCV9588862 | rs995000 | hCV316299 | rs1168026 | 0.51 | 0.9 | 0.959 |
| hCV9588862 | rs995000 | hCV316303 | rs1168031 | 0.51 | 0.9 | 0.9586 |
| hCV9588862 | rs995000 | hCV32220452 | rs12090886 | 0.51 | 0.9 | 1 |
| hCV9588862 | rs995000 | hCV32220453 | rs10889337 | 0.51 | 0.9 | 0.9585 |
| hCV9588862 | rs995000 | hCV32220467 | rs10889333 | 0.51 | 0.9 | 1 |
| hCV9588862 | rs995000 | hCV32220469 | rs10889332 | 0.51 | 0.9 | 0.979 |
| hCV9588862 | rs995000 | hCV32220470 | rs11207974 | 0.51 | 0.9 | 0.959 |
| hCV9588862 | rs995000 | hCV32220491 | rs11577840 | 0.51 | 0.9 | 0.9586 |
| hCV9588862 | rs995000 | hCV32220495 | rs11207969 | 0.51 | 0.9 | 0.979 |
| hCV9588862 | rs995000 | hCV408090 | rs1183260 | 0.51 | 0.9 | 0.9566 |
| hCV9588862 | rs995000 | hCV445207 | rs1627591 | 0.51 | 0.9 | 0.959 |
| hCV9588862 | rs995000 | hCV71419 | rs2131925 | 0.51 | 0.9 | 0.959 |
| hCV9588862 | rs995000 | hCV857102 | rs624660 | 0.51 | 0.9 | 0.979 |
| hCV9588862 | rs995000 | hCV857103 | rs636497 | 0.51 | 0.9 | 0.9577 |
| hCV9588862 | rs995000 | hCV857104 | rs636523 | 0.51 | 0.9 | 1 |
| hCV9588862 | rs995000 | hCV857108 | rs597078 | 0.51 | 0.9 | 0.958 |
| hCV9588862 | rs995000 | hCV857109 | rs597470 | 0.51 | 0.9 | 0.959 |
| hCV9588862 | rs995000 | hCV857110 | rs583609 | 0.51 | 0.9 | 0.979 |
| hCV9588862 | rs995000 | hCV857121 | rs642845 | 0.51 | 0.9 | 0.958 |
| hCV9588862 | rs995000 | hCV857122 | rs656297 | 0.51 | 0.9 | 0.979 |
| hCV9588862 | rs995000 | hCV857123 | rs638305 | 0.51 | 0.9 | 0.959 |
| hCV9588862 | rs995000 | hCV857127 | rs631106 | 0.51 | 0.9 | 0.9577 |
| hCV9588862 | rs995000 | hCV9508668 | rs1781195 | 0.51 | 0.9 | 0.979 |
| hCV9588862 | rs995000 | hCV9581062 | rs998403 | 0.51 | 0.9 | 1 |
| hCV9588862 | rs995000 | hCV9581570 | rs1168036 | 0.51 | 0.9 | 1 |
| hCV9588862 | rs995000 | hCV9581571 | rs1002687 | 0.51 | 0.9 | 0.959 |
| hCV9588862 | rs995000 | hCV9581580 | rs1168032 | 0.51 | 0.9 | 0.958 |
| hCV9588862 | rs995000 | hCV9581581 | rs1168030 | 0.51 | 0.9 | 0.959 |
| hCV9588862 | rs995000 | hCV9581590 | rs1168018 | 0.51 | 0.9 | 0.9789 |
| hCV9588862 | rs995000 | hCV9581606 | rs1168022 | 0.51 | 0.9 | 0.9558 |
| hCV9588862 | rs995000 | hCV9581615 | rs1748201 | 0.51 | 0.9 | 0.9789 |
| hCV9588862 | rs995000 | hCV9581635 | rs1748195 | 0.51 | 0.9 | 0.979 |
| hCV9588862 | rs995000 | hCV9581636 | rs3850634 | 0.51 | 0.9 | 1 |
| hCV9588862 | rs995000 | hCV9581680 | rs1748197 | 0.51 | 0.9 | 0.959 |
| hCV9588862 | rs995000 | hCV9581691 | rs1570694 | 0.51 | 0.9 | 1 |
| hCV9588862 | rs995000 | hCV9583244 | rs783291 | 0.51 | 0.9 | 0.959 |
| hCV9588862 | rs995000 | hCV9588770 | rs1007205 | 0.51 | 0.9 | 0.959 |
| hCV9588862 | rs995000 | hCV9588793 | rs1168009 | 0.51 | 0.9 | 0.9365 |
| hCV9588862 | rs995000 | hCV9588794 | rs1168010 | 0.51 | 0.9 | 0.936 |
| hCV9588862 | rs995000 | hCV9588829 | rs1781212 | 0.51 | 0.9 | 0.959 |
| hCV9588862 | rs995000 | hCV9588850 | rs1168013 | 0.51 | 0.9 | 0.979 |
| hCV9588862 | rs995000 | hCV9588875 | rs1168086 | 0.51 | 0.9 | 0.9551 |
| hCV9588862 | rs995000 | hCV9588886 | rs1168089 | 0.51 | 0.9 | 0.979 |
| hCV9588862 | rs995000 | hCV9588930 | rs1168099 | 0.51 | 0.9 | 0.979 |
| hCV9588862 | rs995000 | hCV9588985 | rs1168124 | 0.51 | 0.9 | 0.959 |
| hCV9588862 | rs995000 | hDV75176134 | rs1781221 | 0.51 | 0.9 | 0.959 |
| hCV9596963 | rs6115 | hCV9596972 | rs6112 | 0.51 | 0.9 | 0.9634 |
| hCV9604851 | rs1805002 | hDV77041261 | rs4758402 | 0.51 | 0.9 | 1 |
| hDV70661573 | rs16875009 | hCV2928259 | rs6867948 | 0.51 | 0.409905558 | 0.656 |
| hDV70661573 | rs16875009 | hCV2928266 | rs11742566 | 0.51 | 0.409905558 | 1 |
| hDV70661573 | rs16875009 | hCV2928267 | rs12517136 | 0.51 | 0.409905558 | 1 |
| hDV70661573 | rs16875009 | hCV2928268 | rs11134096 | 0.51 | 0.409905558 | 1 |
| hDV70661573 | rs16875009 | hCV2928269 | rs11134097 | 0.51 | 0.409905558 | 1 |
| hDV70661573 | rs16875009 | hCV2928270 | rs12515050 | 0.51 | 0.409905558 | 1 |
| hDV70661573 | rs16875009 | hCV2928271 | rs12520783 | 0.51 | 0.409905558 | 1 |
| hDV70661573 | rs16875009 | hCV2928278 | rs12522919 | 0.51 | 0.409905558 | 1 |
| hDV70661573 | rs16875009 | hCV2928283 | rs12518805 | 0.51 | 0.409905558 | 1 |
| hDV70661573 | rs16875009 | hCV2928284 | rs12518833 | 0.51 | 0.409905558 | 1 |
| hDV70661573 | rs16875009 | hCV2928288 | rs11748003 | 0.51 | 0.409905558 | 1 |
| hDV70661573 | rs16875009 | hCV2928289 | rs7446660 | 0.51 | 0.409905558 | 0.4246 |
| hDV70661573 | rs16875009 | hCV2928293 | rs12517784 | 0.51 | 0.409905558 | 1 |
| hDV70661573 | rs16875009 | hCV2928295 | rs1428025 | 0.51 | 0.409905558 | 0.4246 |
| hDV70661573 | rs16875009 | hCV2928306 | rs1428024 | 0.51 | 0.409905558 | 1 |
| hDV70661573 | rs16875009 | hCV32226945 | rs12521996 | 0.51 | 0.409905558 | 1 |
| hDV70661573 | rs16875009 | hCV32226946 | rs12517751 | 0.51 | 0.409905558 | 1 |
| hDV70661573 | rs16875009 | hDV70703783 | rs16874942 | 0.51 | 0.409905558 | 1 |
| hDV70661573 | rs16875009 | hDV70703799 | rs16874970 | 0.51 | 0.409905558 | 1 |
| hDV70661573 | rs16875009 | hDV70703820 | rs16874994 | 0.51 | 0.409905558 | 1 |
| hDV70661573 | rs16875009 | hDV70703822 | rs16874998 | 0.51 | 0.409905558 | 1 |
| hDV70661573 | rs16875009 | hDV70703832 | rs16875012 | 0.51 | 0.409905558 | 1 |
| hDV70661573 | rs16875009 | hDV70703845 | rs16875031 | 0.51 | 0.409905558 | 0.8803 |

TABLE 6-continued

| Interrogated SNP (hCV #) | Interrogated SNP (rs #) | LD SNP (hCV #) | LD SNP (rs #) | Power | Threshold r² | r² |
|---|---|---|---|---|---|---|
| hDV70661573 | rs16875009 | hDV70703846 | rs16875033 | 0.51 | 0.409905558 | 1 |
| hDV70661573 | rs16875009 | hDV70703851 | rs16875038 | 0.51 | 0.409905558 | 1 |
| hDV70938014 | rs17321515 | hCV11593303 | rs2980871 | 0.51 | 0.9 | 0.9634 |
| hDV70938014 | rs17321515 | hCV12004940 | rs2001844 | 0.51 | 0.9 | 1 |
| hDV70938014 | rs17321515 | hCV15883779 | rs2980869 | 0.51 | 0.9 | 1 |
| hDV70938014 | rs17321515 | hCV15883790 | rs2980875 | 0.51 | 0.9 | 0.9619 |
| hDV70938014 | rs17321515 | hCV15954624 | rs2954022 | 0.51 | 0.9 | 0.9634 |
| hDV70938014 | rs17321515 | hCV15954645 | rs2954029 | 0.51 | 0.9 | 0.9634 |
| hDV70938014 | rs17321515 | hCV26372062 | rs2980856 | 0.51 | 0.9 | 1 |
| hDV70938014 | rs17321515 | hCV26372064 | rs2980855 | 0.51 | 0.9 | 1 |
| hDV70938014 | rs17321515 | hCV26372065 | rs2980854 | 0.51 | 0.9 | 1 |
| hDV70938014 | rs17321515 | hCV26372066 | rs2980853 | 0.51 | 0.9 | 1 |
| hDV70938014 | rs17321515 | hCV26372069 | rs2980882 | 0.51 | 0.9 | 1 |
| hDV70938014 | rs17321515 | hCV29719123 | rs6982636 | 0.51 | 0.9 | 1 |
| hDV70938014 | rs17321515 | hCV309481 | rs2954019 | 0.51 | 0.9 | 1 |
| hDV70938014 | rs17321515 | hCV469160 | rs2954031 | 0.51 | 0.9 | 0.9279 |
| hDV70938014 | rs17321515 | hCV85515 | rs10808546 | 0.51 | 0.9 | 0.9064 |
| hDV70973697 | rs17593921 | hDV70715540 | rs16891266 | 0.51 | 0.612665933 | 0.6234 |
| hDV70977122 | rs17616652 | hCV11627552 | rs2316667 | 0.51 | 0.442542981 | 0.7059 |
| hDV70977122 | rs17616652 | hCV1718966 | rs4968305 | 0.51 | 0.442542981 | 0.7074 |
| hDV70977122 | rs17616652 | hCV26683367 | rs9894300 | 0.51 | 0.442542981 | 0.6395 |
| hDV70977122 | rs17616652 | hCV26683368 | rs2004580 | 0.51 | 0.442542981 | 0.6405 |
| hDV70977122 | rs17616652 | hCV29195269 | rs7221042 | 0.51 | 0.442542981 | 0.7843 |
| hDV70977122 | rs17616652 | hCV30515746 | rs10491149 | 0.51 | 0.442542981 | 0.7843 |
| hDV70977122 | rs17616652 | hCV31479223 | rs11570460 | 0.51 | 0.442542981 | 0.7356 |
| hDV70977122 | rs17616652 | hCV31479380 | rs4520895 | 0.51 | 0.442542981 | 0.642 |
| hDV70977122 | rs17616652 | hCV7451110 | rs1515754 | 0.51 | 0.442542981 | 0.7356 |
| hDV70977122 | rs17616652 | hCV9268649 | rs16941168 | 0.51 | 0.442542981 | 0.5852 |
| hDV70977122 | rs17616652 | hDV70590478 | rs9897338 | 0.51 | 0.442542981 | 0.642 |
| hDV70977122 | rs17616652 | hDV70751669 | rs16941353 | 0.51 | 0.442542981 | 0.7843 |
| hDV70977122 | rs17616652 | hDV70751822 | rs16941584 | 0.51 | 0.442542981 | 0.7366 |
| hDV70977122 | rs17616652 | hDV70975179 | rs17603901 | 0.51 | 0.442542981 | 0.6562 |
| hDV70977122 | rs17616652 | hDV70987720 | rs17676978 | 0.51 | 0.442542981 | 0.7843 |
| hDV70977122 | rs17616652 | hDV75285090 | rs2667804 | 0.51 | 0.442542981 | 0.7074 |

TABLE 7

Association test results from two MI case-control studies

| SNP | Gene Symbol | Risk Allele | CCF OR (95% CI) | P | Strata | Model | UCSF OR (95% CI) | P | Strata | Model | Tested* |
|---|---|---|---|---|---|---|---|---|---|---|---|
| rs6668968 | AQP10 | A | 1.29 (1.07-1.57) | 0.008 | ALL | add | 1.16 (1.00-1.35) | 0.050 | ALL | add | † |
| rs13078881 | BTD | G | 2.95 (1.27-6.89) | 0.012 | F | add | 1.73 (0.94-3.20) | 0.079 | F | add | † |
| rs1051038 | COG2 | A | 1.23 (0.99-1.53) | 0.063 | ALL | add | 1.19 (0.97-1.46) | 0.088 | ALL | rec | † |
| rs2035029 | DCC | G | 1.35 (1.04-1.76) | 0.024 | ALL | dom | 1.22 (1.00-1.50) | 0.053 | ALL | dom | † |
| Chr17: 74022684 | DNAHL1 | C | 1.85 (0.95-3.63) | 0.072 | ALL | add | 1.96 (0.97-3.94) | 0.060 | M | add | † |
| rs34639489 | ERV3 | C | 1.16 (0.98-1.38) | 0.092 | ALL | add | 1.13 (0.98-1.30) | 0.086 | ALL | add | † |
| rs4149965 | EXO1 | A | 1.34 (1.03-1.73) | 0.028 | M | add | 1.38 (1.10-1.73) | 0.005 | M | add | † |
| rs2304024 | FAT2 | G | 1.20 (0.97-1.50) | 0.097 | ALL | add | 1.23 (1.04-1.46) | 0.019 | ALL | add | † |
| rs12915 | GALNAC4S-6ST | C | 1.17 (0.98-1.40) | 0.080 | ALL | add | 1.13 (0.98-1.30) | 0.088 | ALL | add | † |
| rs197922 | GOSR2 | A | 1.29 (0.98-1.70) | 0.071 | F | add | 1.17 (1.01-1.34) | 0.032 | ALL | add | † |
| rs2296434 | HPS1 | G | 1.39 (1.01-1.90) | 0.042 | ALL | add | 1.34 (0.96-1.85) | 0.082 | M | add | † |
| rs1060446 | HPSE2 | C | 1.27 (1.07-1.50) | 0.006 | ALL | add | 1.14 (1.00-1.31) | 0.052 | ALL | add | † |
| rs3739998 | KIAA1462 | G | 1.26 (0.96-1.65) | 0.093 | F | add | 1.30 (1.06-1.61) | 0.012 | F | add | † |
| rs3110234 | LIFR | T | 1.19 (0.96-1.46) | 0.066 | ALL | gen | 1.17 (0.99-1.39) | 0.070 | ALL | gen | † |
| rs28756981 | MLH3 | T | 3.23 (1.10-9.50) | 0.033 | M | add | 4.58 (1.28-16.33) | 0.019 | M | add | † |
| rs11051410 | none | G | 1.22 (1.01-1.46) | 0.038 | ALL | add | 1.16 (1.00-1.34) | 0.045 | ALL | add | † |
| rs1023899 | none | A | 1.82 (1.19-2.78) | 0.006 | M | add | 1.40 (0.99-1.97) | 0.059 | M | add | † |
| rs2959189 | none | G | 1.59 (1.10-2.30) | 0.014 | ALL | dom | 1.27 (0.97-1.67) | 0.085 | ALL | dom | † |
| rs10622 | none | T | 1.27 (0.98-1.65) | 0.066 | ALL | rec | 1.28 (1.04-1.57) | 0.018 | ALL | rec | † |
| rs7736962 | none | A | 1.30 (1.01-1.67) | 0.044 | ALL | rec | 1.30 (0.98-1.72) | 0.064 | M | rec | † |
| rs4706769 | none | T | 1.17 (0.99-1.39) | 0.067 | ALL | add | 1.26 (1.04-1.53) | 0.017 | M | add | † |
| rs3196714 | ODAM | T | 1.45 (0.95-2.23) | 0.085 | ALL | dom | 1.32 (0.95-1.82) | 0.095 | ALL | dom | † |
| rs1151640 | OR13G1 | C | 1.34 (1.12-1.60) | 0.001 | ALL | add | 1.16 (1.01-1.33) | 0.042 | ALL | add | † |
| rs11219508 | OR8G2 | C | 1.45 (0.98-2.15) | 0.065 | F | dom | 1.34 (1.01-1.78) | 0.042 | F | dom | † |
| rs2278586 | OXER1 | C | 1.37 (0.98-1.91) | 0.063 | F | add | 1.35 (1.06-1.72) | 0.014 | F | add | † |
| rs2970871 | PPARGC1A | C | 1.17 (0.98-1.40) | 0.080 | ALL | add | 1.26 (0.98-1.61) | 0.072 | ALL | dom | † |
| rs3750533 | PRPF4 | T | 1.21 (0.97-1.52) | 0.099 | M | add | 1.20 (0.98-1.47) | 0.076 | M | add | † |
| rs2297322 | SLC15A1 | C | 1.44 (1.02-2.04) | 0.037 | M | add | 1.32 (0.98-1.76) | 0.066 | M | add | † |

TABLE 7-continued

Association test results from two MI case-control studies

| | Gene | Risk | CCF | | | | UCSF | | | | |
|---|---|---|---|---|---|---|---|---|---|---|---|
| SNP | Symbol | Allele | OR (95% CI) | P | Strata | Model | OR (95% CI) | P | Strata | Model | Tested* |
| rs2072549 | SLC7A4 | A | 1.24 (1.00-1.53) | 0.046 | ALL | add | 1.17 (0.98-1.39) | 0.079 | ALL | add | † |
| rs1785934 | STATIP1 | C | 1.36 (0.98-1.88) | 0.067 | M | dom | 1.25 (1.02-1.53) | 0.029 | ALL | dom | † |
| rs11735477 | TKTL2 | A | 1.35 (1.04-1.75) | 0.026 | ALL | dom | 1.28 (0.95-1.72) | 0.098 | M | dom | † |
| rs1042589 | TPO | C | 1.24 (0.99-1.56) | 0.061 | M | add | 1.19 (1.04-1.36) | 0.011 | ALL | add | † |
| rs1108225 | TRPM3 | A | 1.23 (1.00-1.50) | 0.048 | ALL | add | 1.23 (1.05-1.45) | 0.012 | ALL | add | † |
| rs10083789 | USP31 | A | 1.22 (1.01-1.46) | 0.036 | ALL | add | 1.20 (1.04-1.39) | 0.012 | ALL | add | † |
| rs35305327 | WDR31 | A | 3.64 (1.04-12.75) | 0.043 | ALL | add | 2.48 (1.13-5.46) | 0.023 | ALL | add | † |
| rs1465789 | ZNF132 | G | 1.21 (0.98-1.50) | 0.080 | M | add | 1.19 (0.99-1.43) | 0.071 | M | add | † |
| rs2017252 | ZNF273 | A | 1.17 (0.99-1.39) | 0.066 | ALL | add | 1.18 (1.03-1.35) | 0.017 | ALL | add | † |
| rs2884554 | ZNF714 | G | 1.25 (0.97-1.61) | 0.079 | ALL | add | 1.19 (0.99-1.44) | 0.063 | ALL | add | † |
| rs3027309 | ALOX12B | T | 1.27 (1.02-1.59) | 0.035 | ALL | add | 1.18 (0.99-1.41) | 0.068 | ALL | add | ‡ |
| rs2296436 | HPS1 | T | 1.36 (0.99-1.85) | 0.054 | ALL | add | 1.32 (0.95-1.82) | 0.095 | M | add | ‡ |
| rs1042636 | CASR | G | 1.64 (0.94-2.86) | 0.082 | F | add | 1.30 (1.00-1.70) | 0.047 | ALL | add | ‡ |
| rs1376251 | TAS2R50 | C | 1.26 (1.05-1.52) | 0.014 | ALL | add | 1.23 (1.07-1.41) | 0.004 | ALL | add | ‡ |
| rs12102203 | RC3 | G | 1.38 (1.15-1.64) | <0.001 | ALL | add | 1.18 (1.03-1.35) | 0.014 | ALL | add | ‡ |
| rs2286394 | WDR55 | T | 1.24 (1.01-1.53) | 0.037 | ALL | add | 1.18 (1.00-1.39) | 0.044 | ALL | add | ‡ |
| rs2307469 | EIF2AK2 | C | 1.48 (0.95-2.32) | 0.086 | ALL | add | 1.71 (1.17-2.51) | 0.006 | ALL | add | ‡ |
| rs3213646 | MGC16943 | C | 1.22 (0.97-1.53) | 0.092 | M | add | 1.18 (0.98-1.43) | 0.076 | M | add | ‡ |
| rs5985 | F13A1 | A | 1.23 (1.01-1.51) | 0.040 | ALL | add | 1.21 (1.04-1.41) | 0.013 | ALL | add | ‡ |
| Chr2: | | | | | | | | | | | |
| 37081301 | KIAA1414 | G | 1.54 (1.07-2.20) | 0.019 | ALL | add | 1.59 (1.19-2.12) | 0.002 | ALL | add | ‡§ |
| rs1042164 | IER2 | T | 1.31 (1.03-1.69) | 0.028 | ALL | add | 1.22 (0.98-1.52) | 0.070 | ALL | add | ‡ |
| rs6761276 | IL1F10 | T | 1.25 (1.03-1.50) | 0.020 | ALL | add | 1.23 (1.07-1.41) | 0.004 | ALL | add | ‡ |
| rs6743376 | IL1F10 | C | 1.24 (1.03-1.49) | 0.024 | ALL | add | 1.22 (1.06-1.40) | 0.006 | ALL | add | ‡ |
| rs943133 | LOC391102 | A | 1.24 (1.02-1.51) | 0.030 | ALL | add | 1.19 (1.02-1.38) | 0.023 | ALL | add | ‡ |
| rs3130210 | LOC442203 | T | 1.24 (1.01-1.53) | 0.037 | ALL | add | 1.29 (1.09-1.52) | 0.002 | ALL | add | ‡ |
| rs3129196 | LOC442203 | A | 1.25 (1.02-1.53) | 0.035 | ALL | add | 1.29 (1.10-1.52) | 0.002 | ALL | add | ‡ |
| rs12510359 | PALLD | G | 1.26 (1.05-1.51) | 0.011 | ALL | add | 1.22 (1.07-1.41) | 0.004 | ALL | add | ‡ |
| rs7439293 | PALLD | A | 1.21 (1.01-1.46) | 0.042 | ALL | add | 1.22 (1.06-1.40) | 0.006 | ALL | add | ‡|| |
| rs3798220 | LPA | C | 4.71 (0.00-0.00) | <0.001 | ALL | add | 1.76 (0.00-0.00) | 0.014 | ALL | add | ‡ |
| rs10082504 | MKI67 | C | 1.38 (1.03-1.84) | 0.034 | ALL | add | 1.26 (1.01-1.59) | 0.043 | ALL | add | ‡ |
| rs4750685 | MKI67 | G | 1.33 (0.98-1.81) | 0.069 | ALL | add | 1.26 (1.00-1.59) | 0.054 | ALL | add | ‡¶ |
| rs3900940 | MYH15 | C | 0.32 (0.97-1.78) | 0.078 | F | add | 1.31 (1.05-1.63) | 0.015 | F | add | ‡|| |
| rs12145360 | MYOM3 | A | 1.36 (0.98-1.90) | 0.069 | M | add | 1.59 (1.22-2.07) | 0.001 | M | add | ‡ |
| rs12684749 | NFIB | A | 2.59 (1.39-4.82) | 0.003 | ALL | add | 1.36 (0.95-1.96) | 0.097 | ALL | add | ‡ |
| rs3808117 | GRM8 | T | 1.58 (1.26-1.98) | 0.000 | ALL | add | 1.21 (1.02-1.44) | 0.026 | ALL | add | ‡ |
| rs2277838 | P2RXL1 | A | 1.27 (1.02-1.58) | 0.032 | ALL | add | 1.21 (1.02-1.44) | 0.032 | ALL | add | ‡ |
| rs3813135 | PGLYRP2 | C | 1.25 (0.96-1.63) | 0.095 | ALL | dom | 1.27 (1.04-1.55) | 0.020 | ALL | dom | ‡ |
| rs211070 | PRKG1 | G | 1.71 (1.06-2.76) | 0.029 | ALL | add | 1.42 (1.03-1.97) | 0.034 | ALL | add | ‡ |
| rs619203 | ROS1 | C | 1.31 (1.06-1.61) | 0.012 | ALL | add | 1.30 (1.11-1.52) | 0.001 | ALL | add | ‡ |
| rs529038 | ROS1 | T | 1.31 (1.07-1.61) | 0.010 | ALL | add | 1.31 (1.12-1.53) | 0.001 | ALL | add | ‡ |
| rs17090921 | SERPINA9 | A | 2.31 (1.14-4.66) | 0.019 | F | rec | 1.50 (0.94-2.38) | 0.087 | F | rec | ‡ |
| rs11628722 | SERPINA9 | G | 1.26 (0.99-1.60) | 0.058 | ALL | add | 1.17 (1.00-1.39) | 0.091 | ALL | add | ‡ |
| rs4747647 | TAF3 | A | 1.22 (1.02-1.47) | 0.033 | ALL | add | 1.15 (1.00-1.32) | 0.056 | ALL | add | ‡ |
| rs1010 | VAMP8 | C | 1.36 (1.13-1.64) | 0.001 | ALL | add | 1.25 (1.09-1.43) | 0.002 | ALL | add | ‡|| |
| rs6685323 | AQP10 | T | 1.33 (1.10-1.61) | 0.003 | ALL | add | 1.19 (1.03-1.38) | 0.020 | ALL | add | # |
| rs6480771 | DUSP13 | G | 1.20 (1.01-1.43) | 0.084 | ALL | gen | 1.07 (0.93-1.23) | 0.063 | ALL | gen | # |
| rs887 | FLJ42562 | G | 1.21 (1.01-1.46) | 0.040 | ALL | add | 1.17 (1.01-1.35) | 0.032 | ALL | add | # |
| rs28711149 | OR13G1 | T | 1.21 (1.01-1.45) | 0.038 | ALL | add | 1.29 (0.97-1.72) | 0.083 | ALL | dom | # |
| rs1126799 | TPO | C | 1.16 (0.98-1.37) | 0.091 | ALL | add | 1.22 (0.99-1.51) | 0.064 | ALL | rec | # |

SNP, single nucleotide polymorphism;
CCF, Cleveland Clinic Foundation;
USCF, University of California, San Francisco;
OR, odds ratio;
CI, confidence interval;
*This column indicates the location of published results for the testing of the association for each SNP and incident coronary heart disease in the Atherosclerosis Risk in Communities cohort.;
† Online supplemental table II, Meyer et al., "A GOSR2 variant is associated with hypertension", Hypertension, 2008;
‡ Morrison et al.[33];
§ previously reported as Chr2: 37139448 in build 35;
|| Bare et al.[34];
¶ previously reported as Chr10: 129793007 in build 35;
not reported because good multiplex assays could not be made

TABLE 8

Descriptive information by race and GOSR2 genotype

| | Whites (N = 9,861) | | | | Blacks (N = 3,528) | | | |
|---|---|---|---|---|---|---|---|---|
| | ArgArg (n = 4,264) | LysArg (n = 4,398) | LysLys (n = 1,199) | P* | ArgArg (n = 1,698) | LysArg (n = 1,494) | LysLys (n = 336) | P* |
| Mean ± SD | | | | | | | | |
| Age, y | 54 ± 5.7 | 54 ± 5.7 | 54 ± 5.8 | 0.26 | 53 ± 5.7 | 53 ± 5.9 | 54 ± 5.8 | 0.01 |
| SBP (mm Hg)[†] | 115.5 ± 15.6 | 116.7 ± 16.1 | 116.6 ± 16.0 | <0.01 | 125.4 ± 19.6 | 125.5 ± 20.4 | 128.5 ± 21.2 | 0.15 |
| DBP (mm Hg)[†] | 70.5 ± 9.6 | 70.9 ± 9.8 | 71.0 ± 9.9 | 0.09 | 78.5 ± 11.3 | 78.1 ± 12.0 | 79.2 ± 12.3 | 0.96 |
| Waist circumference (cm) | 95.5 ± 13.4 | 96.4 ± 13.5 | 95.8 ± 13.2 | 0.05 | 99.0 ± 15.5 | 98.8 ± 14.8 | 99.2 ± 14.6 | 0.88 |
| Ln(triglycerides) (mmol/L)[‡] | 0.27 ± 0.50 | 0.29 ± 0.51 | 0.28 ± 0.53 | 0.15 | 0.09 ± 0.46 | 0.09 ± 0.48 | 0.10 ± 0.45 | 0.80 |
| HDL cholesterol (mmol/L) | 1.3 ± 0.4 | 1.3 ± 0.4 | 1.3 ± 0.4 | 0.96 | 1.4 ± 0.4 | 1.4 ± 0.5 | 1.4 ± 0.5 | 0.13 |
| Glucose (mmol/L)[§] | 5.5 ± 0.5 | 5.5 ± 0.5 | 5.5 ± 0.5 | 0.93 | 5.5 ± 0.6 | 5.5 ± 0.5 | 5.4 ± 0.6 | 0.15 |
| CA IMT (mm) | 0.73 ± 0.18 | 0.74 ± 0.18 | 0.74 ± 0.17 | 0.02 | 0.74 ± 0.16 | 0.73 ± 0.16 | 0.75 ± 0.17 | 0.60 |
| No. (%) | | | | | | | | |
| Male | 1,952 (46) | 1,983 (45) | 551 (46) | 0.77 | 643 (38) | 542 (36) | 116 (35) | 0.42 |
| Hypertension | 1,012 (24) | 1,181 (27) | 314 (26) | <0.01 | 926 (55) | 797 (53) | 186 (56) | 0.66 |
| Diabetes | 327 (8) | 375 (9) | 105 (9) | 0.26 | 308 (19) | 261 (18) | 65 (20) | 0.68 |

SD, standard deviation;
CA, carotid artery;
IMT, intima media thickness;
*P values are for the differences between genotypes (F-test for continuous variables or $X^2$ test for categorical variables);
[†]Excluding participants taking anti-hypertensive medications;
[‡]among those who fasted for at least 8 hours;
[§]among nondiabetics who fasted for at least 8 hours

TABLE 9

OR and 95% CI for the association between GOSR2 (Lys67Arg, rs197922), hypertension, and carotid artery thickness

| | Whites (N = 9,822) | | | Blacks (N = 3,513) | | |
|---|---|---|---|---|---|---|
| | n | OR (95% CI)* | P[‡] | n | OR (95% CI)* | P[‡] |
| Hypertension | 2,506 | 1.09 (1.02 to 1.17) | 0.01 | 1,909 | 0.96 (0.87 to 1.07) | 0.47 |
| Elevated SBP (≧75% tile) | 2,531 | 1.08 (1.00 to 1.15)[†] | 0.04 | 909 | 1.04 (0.92 to 1.17)[†] | 0.52 |
| Elevated DBP (≧75% tile) | 2,606 | 1.08 (1.01 to 1.16)[†] | 0.02 | 904 | 1.03 (0.92 to 1.16)[†] | 0.57 |
| Thick CA IMT[§] (≧75% tile) | 2,284 | 1.09 (1.01 to 1.17) | 0.02 | 830 | 0.99 (0.88 to 1.13) | 0.92 |

OR, odds ratio;
CI, confidence interval;
n, number of affected;
SBP, systolic blood pressure;
DBP, diastolic blood pressure;
CA, carotid artery;
IMT, intima media thickness;
*adjusted for gender and age at baseline;
[†]additionally adjusted for anti-hypertensive medication use;
[‡]P is Wald test p-value;
[§]N = 9,302 whites and 3,146 blacks

TABLE 10

| UCSF1 | | | | | | | |
|---|---|---|---|---|---|---|---|
| marker | rs | Gene | RiskAllele | NonRiskAllele | Case Samples** | Control Samples** | Case Allele Freq* |
| hCV11623551 | rs8073829 | LOC731128 | C | T | 754 | 971 | 0.88 |
| hCV15885004 | rs2277614 | LRRC37A2 | A | G | 753 | 970 | 0.04 |
| hCV2275263 | rs197912 | LRRC37A2 | A | T | 754 | 972 | 0.38 |
| hCV2275272 | rs197920 | GOSR2 | T | C | 721 | 861 | 0.32 |
| hCV2275276 | rs197925 | GOSR2 | A | G | 716 | 862 | 0.41 |
| hCV2592654 | rs1662577 | LRRC37A2 | A | C | 753 | 970 | 0.40 |
| hCV2592662 | rs2191033 | GOSR2 | G | A | 715 | 859 | 0.41 |
| hCV2592715 | rs3851792 | LRRC37A2 | A | T | 715 | 859 | 0.57 |
| hCV2592759 | rs8080126 | LRRC37A2 | A | C | 754 | 973 | 0.73 |
| hCV26660340 | rs4968246 | LRRC37A2 | G | C | 754 | 973 | 0.40 |

TABLE 10-continued

| UCSF1 | | | | | | | | |
|---|---|---|---|---|---|---|---|---|
| hCV26683367 | rs9894300 | LOC731128 | G | C | 754 | 973 | 0.88 | |
| hCV26683368 | rs2004580 | LOC731128 | C | T | 755 | 973 | 0.88 | |
| hCV29195255 | rs8068715 | LRRC37A2 | C | A | 723 | 858 | 0.57 | |
| hCV29195260 | rs3851798 | LRRC37A2 | A | G | 725 | 863 | 0.57 | |
| hCV2960489 | rs3785889 | GOSR2 | G | A | 719 | 861 | 0.51 | |
| hCV31466171 | rs10853085 | LRRC37A2 | G | A | 718 | 863 | 0.40 | |
| hCV341736 | rs11653589 | LRRC37A2 | T | C | 724 | 860 | 0.58 | |
| hCV537525 | rs197943 | LRRC37A2 | C | A | 754 | 971 | 0.06 | |
| hCV7451269 | rs1662594 | LRRC37A2 | A | G | 725 | 861 | 0.39 | |
| hCV7480314 | rs3851799 | LRRC37A2 | C | T | 724 | 862 | 0.58 | |
| hDV70751699 | rs16941393 | LRRC37A2 | A | T | 755 | 973 | 0.92 | |
| hDV70751704 | rs16941401 | LRRC37A2 | T | A | 752 | 972 | 0.92 | |
| hDV70751706 | rs16941404 | LRRC37A2 | G | C | 754 | 968 | 0.20 | |
| hDV70977122 | rs17616652 | LRRC37A2 | A | G | 752 | 973 | 0.92 | |

| marker | Control Allele Freq* | OR* | OR95L* | OR95U* | P_value | Strata | Model | r^2 with hCV2275273 (GOSR2) |
|---|---|---|---|---|---|---|---|---|
| hCV11623551 | 0.85 | 1.28 | 1.05 | 1.56 | 0.014 | AllvsAll | add | 0.043 |
| hCV15885004 | 0.03 | 1.47 | 1.02 | 2.13 | 0.041 | AllvsAll | add | 0.061 |
| hCV2275263 | 0.35 | 1.17 | 1.02 | 1.35 | 0.026 | AllvsAll | add | 0.851 |
| hCV2275272 | 0.29 | 1.15 | 0.99 | 1.33 | 0.076 | AllvsAll | add | 0.82 |
| hCV2275276 | 0.38 | 1.15 | 1.00 | 1.33 | 0.057 | AllvsAll | add | 0.737 |
| hCV2592654 | 0.37 | 1.13 | 0.99 | 1.30 | 0.076 | AllvsAll | add | 0.806 |
| hCV2592662 | 0.38 | 1.16 | 1.01 | 1.34 | 0.041 | AllvsAll | add | 0.739 |
| hCV2592715 | 0.54 | 1.14 | 0.98 | 1.31 | 0.085 | AllvsAll | add | 0.252 |
| hCV2592759 | 0.71 | 1.14 | 0.98 | 1.32 | 0.095 | AllvsAll | add | 0.015 |
| hCV26660340 | 0.36 | 1.15 | 1.00 | 1.32 | 0.045 | AllvsAll | add | 0.541 |
| hCV26683367 | 0.85 | 1.28 | 1.05 | 1.56 | 0.014 | AllvsAll | add | 0.043 |
| hCV26683368 | 0.85 | 1.26 | 1.04 | 1.54 | 0.019 | AllvsAll | add | 0.044 |
| hCV29195255 | 0.54 | 1.14 | 0.99 | 1.32 | 0.066 | AllvsAll | add | 0.254 |
| hCV29195260 | 0.54 | 1.15 | 1.00 | 1.33 | 0.056 | AllvsAll | add | 0.254 |
| hCV2960489 | 0.47 | 1.16 | 1.00 | 1.33 | 0.044 | AllvsAll | add | 0.512 |
| hCV31466171 | 0.37 | 1.15 | 0.99 | 1.32 | 0.062 | AllvsAll | add | 0.79 |
| hCV341736 | 0.54 | 1.16 | 1.00 | 1.34 | 0.046 | AllvsAll | add | 0.25 |
| hCV537525 | 0.04 | 1.45 | 1.07 | 1.97 | 0.016 | AllvsAll | add | 0.028 |
| hCV7451269 | 0.36 | 1.13 | 0.98 | 1.31 | 0.088 | AllvsAll | add | 0.796 |
| hCV7480314 | 0.54 | 1.14 | 0.99 | 1.32 | 0.068 | AllvsAll | add | 0.253 |
| hDV70751699 | 0.90 | 1.22 | 0.96 | 1.55 | 0.098 | AllvsAll | add | 0 |
| hDV70751704 | 0.90 | 1.23 | 0.97 | 1.56 | 0.089 | AllvsAll | add | 0 |
| hDV70751706 | 0.18 | 1.17 | 0.99 | 1.39 | 0.068 | AllvsAll | add | 0.453 |
| hDV70977122 | 0.89 | 1.46 | 1.16 | 1.84 | 0.001 | AllvsAll | add | 0.042 | notes:
*allele frequency, OR, and p-value are for the risk allele
**valid counts for each SNP
Study design in UCSF1: MI cases vs No CHD controls

TABLE 11

Risk factors for MI in participants of three case-control studies

| | Study 1 | | Study 2 | | Study 3 | |
|---|---|---|---|---|---|---|
| | Cases (n = 762) | Controls (n = 857) | Cases (n = 579) | Controls (n = 1159) | Cases (n = 475) | Controls (n = 619) |
| Male, % | 60 | 41 | 81 | 42 | 61 | 62 |
| Age at enrollment, median (range) | 62 (29-87) | 65 (24-100) | 66 (28-88) | 58 (45-97) | 60 (32-86) | 58 (37-88) |
| Age at MI, median (range) | 52 (27-82) | NA | 57 (21-70) | NA | 53 (29-77)[†] | NA |
| Smoking, % | 66 | 45 | 68 | 40 | 73 | 54 |
| Diabetes, % | 20 | 0[‡] | 25 | 0[‡] | 38 | 10 |
| Dyslipidemia[§], % | 84 | 53 | 84 | 61 | 95 | 56 |
| Hypertension[‖], % | 61 | 32 | 66 | 33 | 96 | 78 |
| BMI (kg/m$^2$), mean ± SD | 28 ± 5 | 26 ± 5 | 28 ± 5 | 26 ± 5 | 31 ± 6 | 30 ± 7 |

[†]Data available for 254 cases.
[‡]Individuals with diabetes were excluded from control group.
[§]Dyslipidemia was defined in Study 1 and Study 2 to be self-reported history of a physician diagnosis of dyslipidemia or the use of lipid lowering prescription medication (s) and defined in Study 3 to be the use of lipid lowering prescription medication (s), LDL cholesterol >129 mg/dL, triglycerides >149 mg/dL or HDL cholesterol <45 mg/dL.
[‖]Hypertension was defined in Study 1 and Study 2 to be a self-reported history of a physician diagnosis of hypertension or use of antihypertensive prescription medication (s) and defined in Study 3 to be the use of antihypertensive prescription medication (s), systolic blood pressure >160 mmHg, or diastolic blood pressure >90 mmHg.
NA; not applicable.

TABLE 12

Twenty-four SNPs associated with MI in Study 1 and Study 2

| | | | Study 1 | | | | Study 2 | | | |
|---|---|---|---|---|---|---|---|---|---|---|
| SNP | Gene Symbol | Risk Allele | Risk Allele Freq. | P value | OR | 95% CI | Risk Allele Freq. | P value (1-sided) | OR | 90% CI |
| rs11568658 | ABCC4 | G | 0.97 | 0.005 | 1.98 | 1.24-3.16 | 0.97 | 0.01 | 1.81 | 1.19-2.77 |
| rs16875009 | ADAMTS16 | A | 0.13 | 0.005 | 1.33 | 1.09-1.62 | 0.13 | 0.005 | 1.29 | 1.10-1.51 |
| rs25651 | ANPEP | T | 0.29 | 0.0001 | 1.36 | 1.17-1.58 | 0.31 | 0.02 | 1.17 | 1.03-1.33 |
| rs439401 | APOE | T | 0.35 | 0.03 | 1.17 | 1.01-1.35 | 0.37 | 0.01 | 1.19 | 1.05-1.35 |
| rs867852 | C1orf81 | T | 0.78 | 0.03 | 1.22 | 1.02-1.45 | 0.78 | 0.04 | 1.17 | 1.01-1.37 |
| rs28372907 | DHX33 | A | 0.18 | 0.03 | 1.21 | 1.02-1.44 | 0.18 | 0.01 | 1.22 | 1.05-1.42 |
| rs11553576 | EML3 | T | 0.60 | 0.03 | 1.17 | 1.02-1.35 | 0.60 | 0.03 | 1.16 | 1.02-1.31 |
| rs1325920 | ENO1 | A | 0.80 | 0.02 | 1.24 | 1.03-1.48 | 0.80 | 0.007 | 1.26 | 1.08-1.48 |
| rs31208 | FAM71B | G | 0.11 | 0.03 | 1.27 | 1.03-1.57 | 0.12 | 0.006 | 1.30 | 1.09-1.55 |
| rs3793456 | FXN | G | 0.56 | 0.01 | 1.20 | 1.05-1.39 | 0.55 | 0.03 | 1.15 | 1.02-1.30 |
| rs10890 | FXN | T | 0.43 | 0.004 | 1.23 | 1.07-1.42 | 0.43 | 0.03 | 1.15 | 1.02-1.30 |
| rs35410698 | HLA-DPB2 | G | 0.93 | 0.02 | 1.43 | 1.06-1.91 | 0.94 | 0.006 | 1.53 | 1.16-2.03 |
| rs1136141 | HSPA8 | G | 0.86 | 0.05 | 1.24 | 1.00-1.53 | 0.86 | 0.02 | 1.26 | 1.05-1.52 |
| rs7928656 | KCTD14 | A | 0.84 | 0.04 | 1.23 | 1.01-1.51 | 0.84 | 0.004 | 1.32 | 1.11-1.57 |
| rs3740918 | KIRREL3 | G | 0.69 | 0.003 | 1.26 | 1.08-1.46 | 0.70 | 0.01 | 1.20 | 1.05-1.37 |
| rs725660 | LOC388553 | A | 0.34 | 0.006 | 1.23 | 1.06-1.42 | 0.35 | 0.0009 | 1.26 | 1.12-1.43 |
| rs3798220 | LPA | C | 0.02 | 0.04 | 1.59 | 1.03-2.48 | 0.02 | 0.008 | 1.72 | 1.19-2.49 |
| rs11711953 | MAP4 | T | 0.07 | 0.03 | 1.34 | 1.03-1.73 | 0.07 | 0.01 | 1.35 | 1.09-1.67 |
| rs4907956 | OLFM3 | G | 0.60 | 0.03 | 1.18 | 1.02-1.36 | 0.61 | 0.01 | 1.19 | 1.05-1.34 |
| rs2290819 | PTPRM | T | 0.38 | 0.03 | 1.17 | 1.01-1.35 | 0.38 | 0.008 | 1.20 | 1.06-1.35 |
| rs3204635 | STAC3 | A | 0.25 | 0.02 | 1.20 | 1.03-1.40 | 0.26 | 0.03 | 1.16 | 1.02-1.33 |
| rs1866389 | THBS4 | C | 0.20 | 0.03 | 1.21 | 1.02-1.43 | 0.20 | 0.03 | 1.19 | 1.03-1.37 |
| rs3812475 | TRMT12 | T | 0.50 | 0.03 | 1.16 | 1.01-1.34 | 0.52 | 0.04 | 1.13 | 1.01-1.28 |
| rs862708 | ZNF304 | C | 0.02 | 0.003 | 1.88 | 1.24-2.83 | 0.03 | 0.03 | 1.45 | 1.05-2.00 |

TABLE 13

Genotypic association of five SNPs in Study 3

| SNP | | Cases | Controls | Age and Sex adjusted | | | Fully Adjusted | | |
|---|---|---|---|---|---|---|---|---|---|
| (gene symbol) | Genotype | n (%) | n (%) | OR | 90% CI | P value | OR | 90% CI | P value |
| rs1325920 | AA | 327 (71) | 394 (65) | 1.61 | 0.92-2.81 | 0.08 | 1.28 | 0.62-2.62 | 0.3 |
| (ENO1) | GA | 120 (26) | 186 (31) | 1.25 | 0.70-2.22 | 0.3 | 1.20 | 0.57-2.54 | 0.3 |
| | GG | 14 (3) | 27 (4) | ref | | | ref | | |
| | Additive | | | 1.28 | 1.06-1.55 | 0.01 | 1.09 | 0.85-1.38 | 0.3 |
| rs10890 | TT | 117 (25) | 98 (16) | 1.52 | 1.14-2.04 | 0.009 | 1.49 | 1.02-2.18 | 0.04 |
| (FXN) | CT | 201 (44) | 325 (54) | 0.79 | 0.62-0.99 | 0.9 | 0.85 | 0.63-1.16 | 0.8 |
| | CC | 143 (31) | 183 (30) | ref | | | ref | | |
| | Additive | | | 1.18 | 1.02-1.37 | 0.03 | 1.18 | 0.98-1.42 | 0.07 |
| rs3793456 | GG | 174 (38) | 180 (30) | 1.33 | 0.98-1.80 | 0.06 | 1.50 | 1.01-2.22 | 0.04 |
| (FXN) | AG | 205 (45) | 319 (53) | 0.88 | 0.66-1.18 | 0.8 | 1.00 | 0.69-1.45 | 0.5 |
| | AA | 78 (17) | 107 (18) | ref | | | ref | | |
| | Additive | | | 1.21 | 1.04-1.40 | 0.02 | 1.26 | 1.05-1.53 | 0.02 |
| rs35410698 | GG | 426 (92) | 539 (89) | 1.56 | 1.09-2.22 | 0.02 | 2.07 | 1.31-3.27 | 0.004 |
| (HLA-DPB2) | GA | 36 (8) | 70 (11) | ref | | | ref | | |
| | Additive | | | 1.46 | 1.03-2.06 | 0.04 | 1.79 | 1.14-2.81 | 0.02 |
| rs3798220 | CT | 41 (9) | 12 (2) | 4.63 | 2.67-8.03 | <0.001 | 3.52 | 1.85-6.69 | 0.001 |
| (LPA) | TT | 416 (91) | 573 (98) | ref | | | ref | | |
| | Additive | | | 4.63 | 2.67-8.03 | <0.001 | 3.52 | 1.85-6.69 | 0.001 |

TABLE 14

| | | | | UCSF1(S0012) | | | | | | | | |
|---|---|---|---|---|---|---|---|---|---|---|---|---|
| Marker | gene | Non-Risk Allele | Risk Allele | Case Samples** | Control Samples** | Case Allele Freq* | Control Allele Freq* | OR* | OR95L* | OR95U* | P-value* | stratum | Model |
| hCV16065831 | ENO1 | T | C | 735 | 854 | 0.55 | 0.51 | 1.15 | 1.00 | 1.33 | 0.051 | All | additive |
| hCV25996298 | SLC45A1 | T | G | 734 | 855 | 0.82 | 0.80 | 1.16 | 0.97 | 1.39 | 0.095 | All | additive |
| hCV3086961 | RERE | C | A | 735 | 858 | 0.81 | 0.78 | 1.27 | 1.07 | 1.52 | 0.007 | All | additive |
| hCV3087016 | RERE | C | A | 736 | 848 | 0.80 | 0.77 | 1.19 | 1.00 | 1.41 | 0.050 | All | additive |
| hCV32055477 | RERE | G | A | 733 | 845 | 0.81 | 0.77 | 1.31 | 1.10 | 1.58 | 0.002 | All | additive |
| hCV32055625 | | T | C | 733 | 852 | 0.82 | 0.78 | 1.28 | 1.05 | 1.50 | 0.011 | All | additive |
| hCV32055654 | | G | A | 737 | 853 | 0.31 | 0.27 | 1.19 | 1.02 | 1.39 | 0.024 | All | additive |

TABLE 14-continued

| Marker | gene | | | Case Samples** | Control Samples** | Case Allele Freq* | Control Allele Freq* | OR* | OR95L* | OR95U* | P-value* | stratum | Model |
|---|---|---|---|---|---|---|---|---|---|---|---|---|---|
| hCV8824394 | RERE | T | G | 738 | 853 | 0.82 | 0.79 | 1.21 | 1.01 | 1.44 | 0.037 | All | additive |
| hCV8881160 | RERE | C | T | 732 | 852 | 0.92 | 0.89 | 1.38 | 1.08 | 1.77 | 0.009 | All | additive |
| hCV11398434 | RERE | C | T | 736 | 854 | 0.81 | 0.77 | 1.28 | 1.07 | 1.52 | 0.006 | All | additive |
| hCV11398437 | RERE | C | T | 726 | 838 | 0.82 | 0.79 | 1.28 | 1.07 | 1.54 | 0.007 | All | additive |
| hCV1188747 | RERE | G | C | 737 | 854 | 0.58 | 0.53 | 1.21 | 1.05 | 1.39 | 0.007 | All | additive |
| hCV29819064 | RERE | C | T | 737 | 854 | 0.81 | 0.78 | 1.24 | 1.04 | 1.48 | 0.015 | All | additive |
| hCV2987229 | RERE | C | T | 735 | 853 | 0.55 | 0.52 | 1.15 | 1.00 | 1.32 | 0.054 | All | additive |
| hCV2987250 | RERE | G | C | 737 | 854 | 0.81 | 0.77 | 1.24 | 1.04 | 1.47 | 0.015 | All | additive |
| hCV30233468 | RERE | G | A | 736 | 858 | 0.56 | 0.52 | 1.17 | 1.02 | 1.35 | 0.026 | All | additive |
| hCV30287627 | RERE | T | A | 735 | 854 | 0.60 | 0.58 | 1.16 | 1.01 | 1.33 | 0.039 | All | additive |
| hCV30487730 | RERE | T | C | 732 | 855 | 0.80 | 0.76 | 1.25 | 1.05 | 1.49 | 0.011 | All | additive |
| hCV3086932 | RERE | G | T | 675 | 785 | 0.77 | 0.72 | 1.27 | 1.07 | 1.52 | 0.007 | All | additive |
| hCV3086950 | RERE | A | G | 737 | 858 | 0.80 | 0.76 | 1.26 | 1.06 | 1.50 | 0.006 | All | additive |
| hCV3086983 | RERE | T | C | 734 | 851 | 0.19 | 0.17 | 1.22 | 1.02 | 1.48 | 0.034 | All | additive |
| hCV32055474 | RERE | G | C | 736 | 852 | 0.81 | 0.77 | 1.28 | 1.07 | 1.52 | 0.006 | All | additive |
| hCV32055581 | RERE | A | G | 738 | 854 | 0.29 | 0.26 | 1.16 | 0.99 | 1.35 | 0.065 | All | additive |
| hCV32055596 | RERE | G | A | 735 | 854 | 0.82 | 0.79 | 1.26 | 1.05 | 1.51 | 0.012 | All | additive |
| hCV8379452 | | T | C | 737 | 853 | 0.56 | 0.51 | 1.19 | 1.04 | 1.37 | 0.012 | All | additive |
| hCV8824244 | ENO1 | T | C | 735 | 851 | 0.81 | 0.79 | 1.19 | 0.99 | 1.42 | 0.063 | All | additive |
| hCV8824248 | ENO1 | A | G | 736 | 855 | 0.82 | 0.79 | 1.20 | 1.01 | 1.44 | 0.042 | All | additive |

| | UCSF2(S0061) | | | | | | | | | r2 with hCV8824241 (ENO1)*** |
|---|---|---|---|---|---|---|---|---|---|---|
| Marker | Case Samples** | Control Samples** | Case Allele Freq* | Control Allele Freq* | OR* | OR95L* | OR95U* | P-value* | stratum | Model | |
| hCV16065831 | 558 | 1152 | 0.58 | 0.52 | 1.18 | 1.02 | 1.38 | 0.0225 | All | additive | 0.238 |
| hCV25996298 | 565 | 1152 | 0.82 | 0.79 | 1.24 | 1.03 | 1.48 | 0.0211 | All | additive | 0.214 |
| hCV3086961 | 558 | 1154 | 0.82 | 0.77 | 1.34 | 1.12 | 1.60 | 0.0018 | All | additive | 0.451 |
| hCV3087016 | 558 | 1145 | 0.81 | 0.77 | 1.28 | 1.06 | 1.51 | 0.0105 | All | additive | 0.418 |
| hCV32055477 | 555 | 1149 | 0.82 | 0.77 | 1.33 | 1.11 | 1.59 | 0.0019 | All | additive | 0.442 |
| hCV32055625 | 557 | 1153 | 0.82 | 0.78 | 1.27 | 1.07 | 1.52 | 0.0077 | All | additive | 0.596 |
| hCV32055654 | 557 | 1153 | 0.31 | 0.29 | 1.35 | 0.97 | 1.88 | 0.0739 | All | recessive | 0.059 |
| hCV8824394 | 557 | 1154 | 0.82 | 0.78 | 1.28 | 1.08 | 1.53 | 0.0064 | All | additive | 0.342 |
| hCV8881160 | 558 | 1152 | 0.91 | 0.89 | 1.30 | 1.02 | 1.65 | 0.0324 | All | additive | 0.327 |
| hCV11398434 | | | | | | | | | | | 0.458 |
| hCV11398437 | | | | | | | | | | | 0.45 |
| hCV1188747 | | | | | | | | | | | 0.171 |
| hCV29819064 | | | | | | | | | | | 0.442 |
| hCV2987229 | | | | | | | | | | | 0.102 |
| hCV2987250 | | | | | | | | | | | 0.416 |
| hCV30233468 | | | | | | | | | | | 0.162 |
| hCV30287627 | | | | | | | | | | | 0.149 |
| hCV30487730 | | | | | | | | | | | 0.418 |
| hCV3086932 | | | | | | | | | | | 0.38 |
| hCV3086950 | | | | | | | | | | | 0.425 |
| hCV3086983 | | | | | | | | | | | 0.025 |
| hCV32055474 | | | | | | | | | | | 0.451 |
| hCV32055581 | | | | | | | | | | | 0.047 |
| hCV32055596 | | | | | | | | | | | 0.548 |
| hCV8379452 | | | | | | | | | | | 0.157 |
| hCV8824244 | | | | | | | | | | | 0.885 |
| hCV8824248 | | | | | | | | | | | 0.87 | note:
*allele frequency, OR, and p-value are for the risk allele
**valid counts for each SNP
***based on UCSF1
Study design in UCSF1 and UCSF2: MI cases vs No CHD controls

TABLE 15

| | | | | UCSF1(S0012) | | | | | | | | |
|---|---|---|---|---|---|---|---|---|---|---|---|---|
| Marker | gene | Non Risk Allele | Risk Allele | Case Samples** | Control Samples** | Case Allele Freq* | Control Allele Freq* | OR* | OR95L* | OR95U* | P-value* | stratum | Model |
| hCV29033518 | | A | T | 737 | 854 | 0.09 | 0.07 | 1.28 | 0.99 | 1.64 | 0.0569 | additive | ALL_ALL |
| hCV472000 | TJP2 | G | A | 734 | 853 | 0.10 | 0.07 | 1.33 | 1.03 | 1.70 | 0.0263 | additive | ALL_ALL |
| hCV28008078 | FXN | C | T | 735 | 855 | 0.58 | 0.54 | 1.18 | 1.02 | 1.35 | 0.0219 | additive | ALL_ALL |
| hCV30586985 | FXN | A | G | 738 | 855 | 0.60 | 0.55 | 1.23 | 1.08 | 1.41 | 0.0047 | additive | ALL_ALL |
| hCV27970553 | TJP2 | T | C | 731 | 850 | 0.43 | 0.40 | 1.17 | 1.01 | 1.35 | 0.0344 | additive | ALL_ALL |
| hCV7442005 | TJP2 | G | A | 737 | 851 | 0.49 | 0.44 | 1.22 | 1.08 | 1.40 | 0.0065 | additive | ALL_ALL |
| hCV1463112 | | C | T | 734 | 853 | 0.59 | 0.55 | 1.16 | 1.01 | 1.34 | 0.0333 | additive | ALL_ALL |
| hCV15892430 | FXN | C | T | 731 | 849 | 0.58 | 0.51 | 1.23 | 1.07 | 1.42 | 0.0038 | additive | ALL_ALL |
| hCV1463224 | FXN | T | C | 737 | 854 | 0.49 | 0.43 | 1.25 | 1.08 | 1.44 | 0.0022 | additive | ALL_ALL |

TABLE 15-continued

| | | | | | | | | | | | | | |
|---|---|---|---|---|---|---|---|---|---|---|---|---|---|
| hCV1463222 | FXN | C | T | 730 | 858 | 0.49 | 0.43 | 1.26 | 1.10 | 1.46 | 0.0011 | additive | ALL_ALL |
| hCV11761245 | TJP2 | C | T | 735 | 855 | 0.48 | 0.43 | 1.21 | 1.05 | 1.39 | 0.0071 | additive | ALL_ALL |
| hCV1483184 | FXN | T | C | 735 | 853 | 0.81 | 0.79 | 1.73 | 1.06 | 2.83 | 0.0289 | dominant | ALL_ALL |
| hCV1844077 | TJP2 | G | A | 736 | 855 | 0.75 | 0.72 | 1.19 | 0.98 | 1.45 | 0.0863 | recessive | ALL_ALL |

| | UCSF2(S0061) | | | | | | | | | | r2 with |
|---|---|---|---|---|---|---|---|---|---|---|---|
| Marker | Case Samples** | Control Samples** | Case Allele Freq* | Control Allele Freq* | OR* | OR95L* | OR95U* | P-value* | stratum | Model | hCV1463226 (FXN)*** |
| hCV29033518 | 558 | 1152 | 0.10 | 0.08 | 1.23 | 0.96 | 1.58 | 0.0977 | add | ALL_ALL | 0.042 |
| hCV472000 | 557 | 1150 | 0.09 | 0.07 | 1.30 | 0.98 | 1.71 | 0.0653 | dom | ALL_ALL | 0.057 |
| hCV28008078 | | | | | | | | | | | 0.446 |
| hCV30586985 | | | | | | | | | | | 0.572 |
| hCV27970553 | | | | | | | | | | | 0.237 |
| hCV7442005 | | | | | | | | | | | 0.325 |
| hCV1463112 | | | | | | | | | | | 0.411 |
| hCV15892430 | | | | | | | | | | | 0.435 |
| hCV1463224 | | | | | | | | | | | 0.99 |
| hCV1463222 | | | | | | | | | | | 0.989 |
| hCV11761245 | | | | | | | | | | | 0.343 |
| hCV1483184 | | | | | | | | | | | 0.196 |
| hCV1844077 | | | | | | | | | | | 0 | note:
*allele frequency, OR, and p-value are for the risk allele
**valid counts for each SNP
***based on UCSF1
Study design in UCSF1 and UCSF2: MI cases vs No CHD controls

TABLE 16

UCSF1

| marker | rs | Gene | RiskAllele | NonRiskAllele | Case Samples** | Control Samples** | Case Allele Freq* | Control Allele Freq* |
|---|---|---|---|---|---|---|---|---|
| hCV1188731 | rs4908514 | RERE | T | C | 730 | 793 | 0.82 | 0.79 |
| hCV1188735 | rs10864366 | RERE | C | T | 734 | 793 | 0.82 | 0.79 |
| hCV15967490 | rs2292242 | SLC45A1 | T | C | 728 | 795 | 0.59 | 0.56 |
| hCV27157435 | rs7513420 | RERE | C | T | 735 | 794 | 0.60 | 0.57 |
| hCV27157439 | rs10779704 | RERE | C | A | 729 | 783 | 0.60 | 0.57 |
| hCV27884601 | rs4908776 | RERE | C | T | 734 | 793 | 0.82 | 0.79 |
| hCV27958354 | rs4908762 | RERE | T | C | 731 | 794 | 0.80 | 0.77 |
| hCV28023091 | rs4908773 | RERE | C | T | 736 | 792 | 0.83 | 0.79 |
| hCV29368919 | rs4908513 | RERE | C | T | 729 | 796 | 0.83 | 0.79 |
| hCV2966448 | rs1064826 | RERE | A | G | 734 | 790 | 0.28 | 0.25 |
| hCV29873524 | rs7533113 | RERE | T | C | 725 | 793 | 0.82 | 0.79 |
| hCV29945430 | rs7517436 | RERE | T | G | 734 | 789 | 0.82 | 0.78 |
| hCV3086948 | rs10864361 | RERE | C | T | 734 | 794 | 0.59 | 0.56 |
| hCV3087000 | rs1463055 | RERE | A | G | 736 | 796 | 0.81 | 0.77 |
| hCV3087003 | rs6577500 | RERE | C | G | 734 | 793 | 0.80 | 0.77 |
| hCV3087008 | rs12136689 | RERE | C | A | 723 | 794 | 0.33 | 0.29 |
| hCV3087015 | rs11121198 | RERE | G | C | 735 | 792 | 0.81 | 0.77 |
| hCV32055527 | rs10864364 | RERE | A | C | 736 | 795 | 0.83 | 0.79 |
| hCV32055595 | rs6577524 | RERE | T | C | 734 | 792 | 0.83 | 0.79 |
| hCV529178 | rs301811 | RERE | T | C | 732 | 789 | 0.81 | 0.77 |
| hCV597227 | rs301809 | RERE | T | C | 736 | 793 | 0.81 | 0.77 |
| hCV8823713 | rs1472228 | RERE | T | C | 736 | 791 | 0.82 | 0.79 |
| hCV8824424 | rs1058790 | RERE | A | G | 735 | 793 | 0.82 | 0.79 |
| hCV8824425 | rs1058791 | RERE | A | C | 723 | 792 | 0.82 | 0.79 |
| hCV8824453 | rs1466654 | SLC45A1 | T | G | 732 | 790 | 0.57 | 0.53 |
| hCV8881161 | rs926951 | RERE | G | A | 734 | 789 | 0.80 | 0.77 |
| hCV8881164 | rs1150398 | RERE | T | C | 733 | 786 | 0.98 | 0.97 |

| marker | OR* | OR95L* | OR95U* | P_value | Strata | Model | r^2 with hCV32055477 (RERE) |
|---|---|---|---|---|---|---|---|
| hCV1188731 | 1.26 | 1.05 | 1.51 | 0.0141 | AllvsAll | add | 0.689 |
| hCV1188735 | 1.25 | 1.05 | 1.50 | 0.0148 | AllvsAll | add | 0.705 |
| hCV15967490 | 1.17 | 1.01 | 1.35 | 0.0367 | AllvsAll | add | 0.167 |
| hCV27157435 | 1.17 | 1.01 | 1.35 | 0.0351 | AllvsAll | add | 0.358 |
| hCV27157439 | 1.17 | 1.01 | 1.35 | 0.0369 | AllvsAll | add | 0.35 |
| hCV27884601 | 1.25 | 1.05 | 1.51 | 0.0148 | AllvsAll | add | 0.64 |
| hCV27958354 | 1.23 | 1.03 | 1.46 | 0.0207 | AllvsAll | add | 0.896 |

TABLE 16-continued

UCSF1

| marker | | | | | | | |
|---|---|---|---|---|---|---|---|
| hCV28023091 | 1.31 | 1.09 | 1.57 | 0.0044 | AllvsAll | add | 0.714 |
| hCV29368919 | 1.28 | 1.06 | 1.53 | 0.0087 | AllvsAll | add | 0.691 |
| hCV2966448 | 1.15 | 0.98 | 1.35 | 0.0971 | AllvsAll | add | 0.071 |
| hCV29873524 | 1.27 | 1.05 | 1.52 | 0.0117 | AllvsAll | add | 0.701 |
| hCV29945430 | 1.28 | 1.07 | 1.53 | 0.0076 | AllvsAll | add | 0.641 |
| hCV3086948 | 1.15 | 1.00 | 1.33 | 0.0496 | AllvsAll | add | 0.345 |
| hCV3087000 | 1.26 | 1.06 | 1.50 | 0.0096 | AllvsAll | add | 0.897 |
| hCV3087003 | 1.23 | 1.03 | 1.46 | 0.0202 | AllvsAll | add | 0.907 |
| hCV3087008 | 1.15 | 0.99 | 1.35 | 0.0673 | AllvsAll | add | 0.106 |
| hCV3087015 | 1.25 | 1.05 | 1.49 | 0.0125 | AllvsAll | add | 0.901 |
| hCV32055527 | 1.29 | 1.07 | 1.54 | 0.0067 | AllvsAll | add | 0.699 |
| hCV32055595 | 1.26 | 1.05 | 1.51 | 0.0149 | AllvsAll | add | 0.693 |
| hCV529178 | 1.23 | 1.04 | 1.47 | 0.0178 | AllvsAll | add | 0.895 |
| hCV597227 | 1.26 | 1.06 | 1.50 | 0.0096 | AllvsAll | add | 0.897 |
| hCV8823713 | 1.23 | 1.02 | 1.47 | 0.0276 | AllvsAll | add | 0.698 |
| hCV8824424 | 1.23 | 1.03 | 1.47 | 0.0230 | AllvsAll | add | 0.444 |
| hCV8824425 | 1.20 | 1.00 | 1.44 | 0.0441 | AllvsAll | add | 0.435 |
| hCV8824453 | 1.19 | 1.03 | 1.37 | 0.0187 | AllvsAll | add | 0.149 |
| hCV8881161 | 1.24 | 1.04 | 1.47 | 0.0167 | AllvsAll | add | 0.889 |
| hCV8881164 | 1.53 | 0.94 | 2.48 | 0.0848 | AllvsAll | add | 0.088 | notes:
*allele frequency, OR, and p-value are for the risk allele
**valid counts for each SNP
Study design in UCSF1: MI cases vs No CHD controls

TABLE 17

UCSF1

| marker | rs | Gene | RiskAllele | NonRiskAllele | Case Samples** | Control Samples** | Case Allele Freq* |
|---|---|---|---|---|---|---|---|
| hCV28993059 | rs4832179 | | A | G | 770 | 920 | 0.09 |
| hCV2091649 | rs12714147 | VAMP5 | G | A | 771 | 921 | 0.17 |
| hCV8696079 | rs960066 | | T | G | 723 | 864 | 0.21 |
| hCV2091650 | rs10206961 | RNF181 | T | C | 723 | 862 | 0.42 |
| hCV11504800 | rs10176176 | | T | A | 721 | 861 | 0.48 |
| hCV8696050 | rs1254901 | VAMP8 | G | A | 770 | 920 | 0.70 |
| hCV11942442 | rs1254898 | GGCX | C | T | 718 | 862 | 0.70 |
| hCV2091669 | rs11688233 | | T | A | 723 | 865 | 0.92 |
| hCV2091674 | rs6733550 | TMEM150 | G | T | 716 | 862 | 0.37 |

| marker | Control Allele Freq* | OR* | OR95L* | OR95U* | P value | Strata | Model | r^2 with hCV2091644 (VAMP8) |
|---|---|---|---|---|---|---|---|---|
| hCV28993059 | 0.08 | 1.25 | 0.99 | 1.58 | 0.0653 | All | add | 0.019 |
| hCV2091649 | 0.15 | 1.17 | 0.97 | 1.41 | 0.0935 | All | add | 0.277 |
| hCV8696079 | 0.19 | 1.16 | 0.97 | 1.37 | 0.0986 | All | add | 0.219 |
| hCV2091650 | 0.39 | 1.14 | 0.99 | 1.31 | 0.0706 | All | add | 0.648 |
| hCV11504800 | 0.44 | 1.17 | 1.02 | 1.35 | 0.0291 | All | add | 0.784 |
| hCV8696050 | 0.66 | 1.22 | 1.06 | 1.41 | 0.0072 | All | add | 0.323 |
| hCV11942442 | 0.66 | 1.18 | 1.02 | 1.38 | 0.0272 | All | add | 0.307 |
| hCV2091669 | 0.90 | 1.39 | 1.08 | 1.78 | 0.0102 | All | add | 0.064 |
| hCV2091674 | 0.34 | 1.14 | 0.99 | 1.33 | 0.0755 | All | add | 0.364 | notes:
*allele frequency, OR, and p-value are for the risk allele
**valid counts for each SNP
Study design in UCSF1: MI cases vs No CHD controls

TABLE 18

UCSF1

| marker | rs | Gene | RiskAllele | NonRiskAllele | Case Samples** | Control Samples** | Case Allele Freq* |
|---|---|---|---|---|---|---|---|
| hCV11846435 | rs6929299 | LPA | T | C | 760 | 852 | 0.67 |
| hCV207123 | rs7771801 | LPA | C | G | 757 | 855 | 0.68 |
| hCV25927459 | rs3798221 | LPA | G | T | 752 | 855 | 0.83 |
| hCV27462774 | rs3127583 | | A | G | 735 | 797 | 0.16 |

TABLE 18-continued

| | | | UCSF1 | | | | |
|---|---|---|---|---|---|---|---|
| hCV282793 | rs11751605 | LPA | C | T | 761 | 855 | 0.16 |
| hCV29322781 | rs6921516 | LPA | G | A | 734 | 795 | 0.68 |
| hCV29809835 | rs9457880 | | A | C | 735 | 796 | 0.05 |
| hCV29952522 | rs9457931 | LPAL2 | G | A | 733 | 797 | 0.08 |
| hCV30574599 | rs7770628 | LPA | C | T | 728 | 794 | 0.49 |
| hCV3201490 | rs1321195 | LPA | G | A | 735 | 795 | 0.87 |
| hCV334752 | rs6939089 | LPA | T | C | 758 | 853 | 0.68 |
| hDV70715669 | rs16891445 | | T | A | 735 | 795 | 0.05 |
| hDV70973697 | rs17593921 | SLC22A3 | C | T | 735 | 796 | 0.98 |
| hCV31161091 | rs3127573 | SLC22A2 | G | A | 733 | 788 | 0.13 |
| hCV1550877 | rs6919346 | LPA | C | T | 759 | 851 | 0.85 |
| hCV2335281 | rs519118 | SLC22A3 | T | G | 733 | 796 | 0.54 |
| hCV3111822 | rs316025 | SLC22A2 | T | C | 735 | 794 | 0.28 |
| hCV561574 | rs624319 | SLC22A3 | G | A | 733 | 796 | 0.55 |

| marker | Control Allele Freq* | OR* | OR95L* | OR95U* | P value | Strata | Model | $r^2$ with hCV25930271 (LPA) |
|---|---|---|---|---|---|---|---|---|
| hCV11846435 | 0.61 | 1.26 | 1.09 | 1.46 | 0.0018 | All | add | 0.01 |
| hCV207123 | 0.63 | 1.24 | 1.07 | 1.44 | 0.0038 | All | add | 0.009 |
| hCV25927459 | 0.79 | 1.28 | 1.07 | 1.53 | 0.0058 | All | add | 0.004 |
| hCV27462774 | 0.13 | 1.26 | 1.02 | 1.54 | 0.0304 | All | add | 0.004 |
| hCV282793 | 0.14 | 1.19 | 0.98 | 1.43 | 0.0780 | All | add | 0.005 |
| hCV29322781 | 0.63 | 1.24 | 1.07 | 1.45 | 0.0044 | All | add | 0.008 |
| hCV29809835 | 0.04 | 1.37 | 0.96 | 1.96 | 0.0828 | All | add | 0 |
| hCV29952522 | 0.06 | 1.52 | 1.15 | 2.01 | 0.0030 | All | add | 0.352 |
| hCV30574599 | 0.45 | 1.17 | 1.02 | 1.35 | 0.0281 | All | add | 0.014 |
| hCV3201490 | 0.85 | 1.26 | 1.02 | 1.54 | 0.0292 | All | add | 0.004 |
| hCV334752 | 0.63 | 1.24 | 1.08 | 1.44 | 0.0032 | All | add | 0.009 |
| hDV70715669 | 0.04 | 1.46 | 1.02 | 2.08 | 0.0378 | All | add | 0 |
| hDV70973697 | 0.97 | 1.62 | 1.01 | 2.61 | 0.0475 | All | add | 0 |
| hCV31161091 | 0.11 | 1.27 | 1.00 | 1.61 | 0.0541 | All | dom | 0.004 |
| hCV1550877 | 0.83 | 1.24 | 1.00 | 1.53 | 0.0519 | All | rec | 0.004 |
| hCV2335281 | 0.52 | 1.29 | 1.03 | 1.61 | 0.0284 | All | rec | 0.021 |
| hCV3111822 | 0.26 | 1.42 | 0.95 | 2.12 | 0.0857 | All | rec | 0.005 |
| hCV561574 | 0.52 | 1.29 | 1.03 | 1.61 | 0.0276 | All | rec | 0.021 | notes:
*allele frequency, OR, and p-value are for the risk allele
**valid counts for each SNP
Study design in UCSF1: MI cases vs No CHD controls

TABLE 19

Meta-analysis of UCSF1 and UCSF2

| | | | | | myocardial infarction (MI) risk | | | | |
|---|---|---|---|---|---|---|---|---|---|
| marker | Gene | Chr | Risk Allele | Non-Risk Allele | Case Samples** | Control Samples** | Case Allele Freq* | Control Allele Freq* | OR* | 95% CI* |
| hCV11846435 | LPA | 6 | T | C | 1329 | 1994 | 0.67 | 0.63 | 1.22 | 1.10-1.36 |
| hCV1550877 | LPA | 6 | C | T | 1327 | 2003 | 0.84 | 0.82 | 1.17 | 1.02-1.34 |
| hCV207123 | LPA | 6 | C | G | 1331 | 2010 | 0.68 | 0.65 | 1.17 | 1.05-1.30 |
| hCV2335281 | SLC22A3 | 6 | T | G | 1306 | 1952 | 0.53 | 0.51 | 1.19 | 1.01-1.39 |
| hCV25927459 | LPA | 6 | G | T | 1325 | 2008 | 0.82 | 0.80 | 1.16 | 1.02-1.32 |
| hCV25930271 | LPA | 6 | C | T | 1338 | 2015 | 0.03 | 0.02 | 1.66 | 1.21-2.26 |
| hCV27422538 | LPA | 6 | C | G | 1335 | 2015 | 0.80 | 0.77 | 1.25 | 1.10-1.41 |
| hCV27462774 | | 6 | A | G | 1308 | 1954 | 0.15 | 0.13 | 1.18 | 1.03-1.36 |
| hCV282793 | LPA | 6 | C | T | 1334 | 2010 | 0.16 | 0.14 | 1.20 | 1.04-1.37 |
| hCV29322781 | LPA | 6 | G | A | 1307 | 1949 | 0.68 | 0.65 | 1.16 | 1.04-1.29 |
| hCV29952522 | LPAL2 | 6 | G | A | 1307 | 1952 | 0.08 | 0.06 | 1.36 | 1.12-1.65 |
| hCV30574599 | LPA | 6 | C | T | 1298 | 1944 | 0.48 | 0.46 | 1.09 | 0.99-1.21 |
| hCV3111822 | SLC22A2 | 6 | T | C | 1308 | 1949 | 0.28 | 0.26 | 1.12 | 1.00-1.25 |
| hCV31161091 | SLC22A2 | 6 | G | A | 1307 | 1942 | 0.13 | 0.11 | 1.20 | 1.03-1.39 |
| hCV3201490 | LPA | 6 | G | A | 1308 | 1951 | 0.88 | 0.85 | 1.27 | 1.09-1.47 |
| hCV334752 | LPA | 6 | T | C | 1328 | 2006 | 0.68 | 0.64 | 1.17 | 1.06-1.30 |

TABLE 19-continued

Meta-analysis of UCSF1 and UCSF2

| hCV561574 | SLC22A3 | 6 | G | A | 1307 | 1951 | 0.54 | 0.52 | 1.10 | 0.99-1.21 |
| hDV70973697 | SLC22A3 | 6 | C | T | 1308 | 1951 | 0.98 | 0.97 | 1.31 | 0.96-1.78 |

| | myocardial infarction (MI) risk | | | Lp(a) level | | | | | |
|---|---|---|---|---|---|---|---|---|---|
| marker | P value* | Strata | Model | Samples** | Estimate* | 95% CI* | P value* | Strata | Model |
| hCV11846435 | 0.0001 | AllvsAll | add | 911 | 0.122 | 0.06-0.19 | 1.95E−04 | AllvsAll | add |
| hCV1550877 | 0.0203 | AllvsAll | add | 914 | 0.190 | 0.11-0.27 | 2.73E−06 | AllvsAll | add |
| hCV207123 | 0.0034 | AllvsAll | add | 915 | 0.076 | 0.01-0.14 | 0.0213 | AllvsAll | add |
| hCV2335281 | 0.0324 | AllvsAll | rec | 892 | 0.093 | 0.03-0.15 | 0.0028 | AllvsAll | add |
| hCV25927459 | 0.0198 | AllvsAll | add | 911 | 0.214 | 0.14-0.29 | 4.53E−08 | AllvsAll | add |
| hCV25930271 | 0.0015 | AllvsAll | add | 916 | 0.706 | 0.51-0.91 | 7.59E−12 | AllvsAll | add |
| hCV27422538 | 0.0004 | AllvsAll | add | 917 | 0.236 | 0.16-0.31 | 3.63E−10 | AllvsAll | add |
| hCV27462774 | 0.0214 | AllvsAll | add | 893 | 0.164 | 0.07-0.26 | 5.34E−04 | AllvsAll | add |
| hCV282793 | 0.0106 | AllvsAll | add | 915 | 0.148 | 0.06-0.24 | 0.0012 | AllvsAll | add |
| hCV29322781 | 0.0063 | AllvsAll | add | 892 | 0.076 | 0.01-0.14 | 0.0239 | AllvsAll | add |
| hCV29952522 | 0.0020 | AllvsAll | add | 892 | 0.308 | 0.18-0.44 | 3.07E−08 | AllvsAll | add |
| hCV30574599 | 0.0824 | AllvsAll | add | 887 | 0.089 | 0.03-0.15 | 0.0050 | AllvsAll | add |
| hCV3111822 | 0.0496 | AllvsAll | add | 892 | 0.070 | 0.00-0.14 | 0.0562 | AllvsAll | add |
| hCV31161091 | 0.0202 | AllvsAll | add | 889 | 0.126 | 0.03-0.22 | 0.0127 | AllvsAll | add |
| hCV3201490 | 0.0016 | AllvsAll | add | 893 | 0.233 | 0.14-0.32 | 4.54E−07 | AllvsAll | add |
| hCV334752 | 0.0029 | AllvsAll | add | 911 | 0.073 | 0.01-0.14 | 0.0274 | AllvsAll | add |
| hCV561574 | 0.0676 | AllvsAll | add | 891 | 0.099 | 0.04-0.16 | 0.0013 | AllvsAll | add |
| hDV70973697 | 0.0930 | AllvsAll | add | 891 | 0.210 | 0.04-0.38 | 0.0177 | AllvsAll | add | note:
*Data for allele frequency, OR and P-value were provided for risk alleles in this table
**Valid counts for each SNP
Study design for MI endpoint: MI cases vs controls having no history of CHD in UCSF1 and UCSF2
Study design for Lp(a) level endpoint: all patients with available Lp(a) level in UCSF1 and UCSF2; Lp(a) level was transformed to Log10Lp(a)

TABLE 20

| | | | | | UCSF1(S0012) | | | | | | | |
|---|---|---|---|---|---|---|---|---|---|---|---|---|
| Marker | Gene | chr | Non Risk Allele | Risk Allele | Case Samples** | Control Samples** | Case Allele Freq* | Control Allele Freq* | OR* | 95% CI* | P-value* | stratum | Model |
| hCV22274679 | TRMT12 | 8 | C | T | 737 | 853 | 0.54 | 0.50 | 1.16 | (1.01-1.34) | 0.0344 | All | additive |
| hCV11688401 | OR2H1 | 6 | G | A | 738 | 854 | 0.27 | 0.24 | 1.15 | (0.98-1.35) | 0.0833 | All | additive |
| hDV70661573 | ADAMTS1 | 5 | T | A | 710 | 826 | 0.17 | 0.13 | 1.33 | (1.09-1.62) | 0.0048 | All | additive |
| hCV11854428 | KCNB2 | 8 | T | C | 737 | 856 | 0.13 | 0.11 | 1.21 | (0.97-1.50) | 0.0837 | All | additive |
| hCV2531730 | CHKB | 22 | A | T | 732 | 851 | 0.41 | 0.38 | 1.15 | (1.00-1.33) | 0.0532 | All | additive |
| hCV3259235 | EIF4E3 | 3 | A | G | 732 | 848 | 0.12 | 0.10 | 1.23 | (0.99-1.53) | 0.0640 | All | additive |
| hCV904974 | | 19 | C | T | 729 | 852 | 0.39 | 0.35 | 1.17 | (1.01-1.35) | 0.0325 | All | additive |
| hDV88873046 | C20orf23 | 20 | A | T | 736 | 852 | 0.98 | 0.97 | 1.70 | (1.09-2.66) | 0.0204 | All | additive |

| | | | | UCSF2(S0061) | | | | | | |
|---|---|---|---|---|---|---|---|---|---|---|
| | | | Marker | Case Samples** | Control Samples** | Case Allele Freq* | Control Allele Freq* | OR* | 95% CI* | P-value* | stratum | Model |
| | | | hCV22274679 | 574 | 1157 | 0.55 | 0.52 | 1.13 | (0.98-1.30) | 0.0832 | All | additive |
| | | | hCV11688401 | 558 | 1154 | 0.26 | 0.23 | 1.21 | (0.98-1.48) | 0.0705 | All | dominant |
| | | | hDV70661573 | 558 | 1153 | 0.17 | 0.13 | 1.29 | (1.06-1.56) | 0.0102 | All | additive |
| | | | hCV11854428 | 553 | 1138 | 0.14 | 0.12 | 1.22 | (0.97-1.55) | 0.0918 | All | dominant |
| | | | hCV2531730 | 557 | 1154 | 0.41 | 0.38 | 1.15 | (0.99-1.33) | 0.0659 | All | additive |
| | | | hCV3259235 | 557 | 1152 | 0.12 | 0.10 | 1.21 | (0.96-1.52) | 0.0996 | All | additive |
| | | | hCV904974 | 558 | 1151 | 0.41 | 0.37 | 1.19 | (1.03-1.38) | 0.0200 | All | additive |
| | | | hDV88873046 | 558 | 1154 | 0.98 | 0.97 | 1.52 | (0.95-2.44) | 0.0815 | All | additive | notes:
*allele frequency, OR, and p-value are for the risk allele
**valid counts for each, SNP
Study design in UCSF1 and UCSF2: MI cases vs No CHD controls

TABLE 21

CHD Risk Reduction by Pravastatin in CARE According to SNP Genotypes

| SNP | rs | Gene symbol | Endpoint | Strata | EVENTS (Pravastatin arm) | NONEVENT (Pravastatin arm) | EVENTS (placebo arm) | NONEVENT (placebo arm) |
|---|---|---|---|---|---|---|---|---|
| hCV16189421 | rs1048755 | ATXN3 | endpt1 | TC + TT | 65 | 526 | 62 | 496 |
| hCV16189421 | rs1048755 | ATXN3 | endpt1 | CC | 68 | 729 | 97 | 684 |
| hCV25630686 | | PSMB9 | endpt1 | TC + TT | 5 | 85 | 14 | 78 |
| hCV25630686 | | PSMB9 | endpt1 | CC | 128 | 1206 | 151 | 1134 |
| hCV25631989 | rs1135983 | ATF6 | endpt1 | TC + TT | 26 | 198 | 13 | 187 |
| hCV25631989 | rs1135983 | ATF6 | endpt1 | CC | 107 | 1044 | 145 | 1001 |
| hCV25644901 | | ITGA9 | endpt1 | GA + GG | 9 | 120 | 26 | 103 |
| hCV25644901 | | ITGA9 | endpt1 | AA | 124 | 1171 | 139 | 1111 |
| hCV25651076 | rs5743291 | NOD2 | endpt1 | AG + AA | 28 | 217 | 21 | 195 |
| hCV25651076 | rs5743291 | NOD2 | endpt1 | GG | 104 | 1068 | 144 | 1021 |
| hCV25651174 | rs9277356 | HLA-DPB1 | endpt1 | GA + GG | 76 | 641 | 79 | 625 |
| hCV25651174 | rs9277356 | HLA-DPB1 | endpt1 | AA | 57 | 643 | 86 | 585 |
| hCV25767417 | rs3803430 | ALDH1A3 | endpt1 | GA + GG | 3 | 52 | 14 | 67 |
| hCV25767417 | rs3803430 | ALDH1A3 | endpt1 | AA | 130 | 1239 | 151 | 1145 |
| hCV25922320 | rs12360861 | CD6 | endpt1 | AG + AA | 62 | 439 | 56 | 466 |
| hCV25922320 | rs12360861 | CD6 | endpt1 | GG | 70 | 850 | 109 | 745 |
| hCV25922440 | rs34362748 | GALC | endpt1 | TC + TT | 30 | 377 | 50 | 341 |
| hCV25922440 | rs34362748 | GALC | endpt1 | CC | 103 | 881 | 109 | 849 |
| hCV25922816 | rs36013429 | PPOX | endpt1 | AG + AA | 14 | 184 | 27 | 145 |
| hCV25922816 | rs36013429 | PPOX | endpt1 | GG | 119 | 1075 | 134 | 1045 |
| hCV25926178 | rs12882130 | MARK3 | endpt1 | GC + GG | 80 | 786 | 111 | 714 |
| hCV25926178 | rs12882130 | MARK3 | endpt1 | CC | 52 | 478 | 50 | 477 |
| hCV25926771 | rs4906321 | MARK3 | endpt1 | CT + CC | 79 | 778 | 114 | 711 |
| hCV25926771 | rs4906321 | MARK3 | endpt1 | TT | 53 | 482 | 47 | 478 |
| hCV25927605 | | HLA-DPA1 | endpt1 | TC + TT | 10 | 80 | 3 | 74 |
| hCV25927605 | | HLA-DPA1 | endpt1 | CC | 122 | 1206 | 162 | 1136 |
| hCV25928135 | | ADAM12 | endpt1 | CT + CC | 41 | 479 | 63 | 430 |
| hCV25928135 | | ADAM12 | endpt1 | TT | 92 | 785 | 97 | 756 |
| hCV25941408 | rs28497577 | MYLK | endpt1 | TG + TT | 18 | 238 | 38 | 208 |
| hCV25941408 | rs28497577 | MYLK | endpt1 | GG | 115 | 1052 | 125 | 1010 |
| hCV25942539 | rs2401751 | PTPN21 | endpt1 | AG + AA | 63 | 700 | 98 | 682 |
| hCV25942539 | rs2401751 | PTPN21 | endpt1 | GG | 70 | 559 | 62 | 511 |
| hCV26000635 | rs7020782 | PAPPA | endpt1 | CA + CC | 82 | 665 | 84 | 645 |
| hCV26000635 | rs7020782 | PAPPA | endpt1 | AA | 51 | 624 | 81 | 566 |
| hCV2633049 | rs2302006 | CCL24 | endpt1 | GT + GG | 48 | 440 | 47 | 443 |
| hCV2633049 | rs2302006 | CCL24 | endpt1 | TT | 85 | 849 | 117 | 771 |
| hCV2658421 | rs3176975 | APOH | endpt1 | AC + AA | 48 | 522 | 80 | 494 |
| hCV2658421 | rs3176975 | APOH | endpt1 | CC | 84 | 769 | 84 | 718 |
| hCV2741051 | rs2230806 | ABCA1 | endpt1 | TC + TT | 66 | 645 | 62 | 593 |
| hCV2741051 | rs2230806 | ABCA1 | endpt1 | CC | 67 | 647 | 103 | 624 |
| hCV2741083 | rs4149313 | ABCA1 | endpt1 | CT + CC | 36 | 316 | 23 | 289 |
| hCV2741083 | rs4149313 | ABCA1 | endpt1 | TT | 97 | 976 | 142 | 927 |
| hCV2932115 | rs5517 | KLK1 | endpt1 | CT + CC | 75 | 591 | 77 | 566 |
| hCV2932115 | rs5517 | KLK1 | endpt1 | TT | 58 | 701 | 88 | 651 |
| hCV2983035 | rs9527026 | KL | endpt1 | AG + AA | 36 | 387 | 53 | 321 |
| hCV2983035 | rs9527026 | KL | endpt1 | GG | 97 | 903 | 110 | 893 |
| hCV3026189 | rs11739136 | KCNIP1 | endpt1 | TC + TT | 29 | 241 | 23 | 234 |
| hCV3026189 | rs11739136 | KCNIP1 | endpt1 | CC | 104 | 1050 | 142 | 984 |
| hCV3068176 | rs1801394 | MTRR | endpt1 | AG + AA | 100 | 908 | 110 | 873 |
| hCV3068176 | rs1801394 | MTRR | endpt1 | GG | 33 | 384 | 55 | 345 |
| hCV3111721 | rs33950747 | NPHS1 | endpt1 | TC + TT | 11 | 191 | 19 | 126 |
| hCV3111721 | rs33950747 | NPHS1 | endpt1 | CC | 121 | 1098 | 146 | 1088 |
| hCV529706 | rs428785 | ADAMTS1 | endpt1 | CG + CC | 55 | 569 | 80 | 476 |
| hCV529706 | rs428785 | ADAMTS1 | endpt1 | GG | 77 | 719 | 84 | 735 |
| hCV529710 | rs402007 | ADAMTS1 | endpt1 | CG + CC | 57 | 570 | 81 | 480 |
| hCV529710 | rs402007 | ADAMTS1 | endpt1 | GG | 76 | 720 | 84 | 737 |
| hCV5478 | rs1800574 | TCF1 | endpt1 | TC + TT | 11 | 75 | 4 | 76 |
| hCV5478 | rs1800574 | TCF1 | endpt1 | CC | 122 | 1217 | 161 | 1141 |
| hCV549926 | rs1057141 | Tap1or | endpt1 | CT + CC | 33 | 395 | 58 | 354 |
| hCV549926 | rs1057141 | Tap1or | endpt1 | TT | 99 | 894 | 107 | 857 |
| hCV594695 | rs45551939 | SERPINA1 | endpt1 | AT + AA | 19 | 115 | 11 | 92 |
| hCV594695 | rs45551939 | SERPINA1 | endpt1 | TT | 112 | 1169 | 154 | 1121 |
| hCV598677 | rs5370 | EDN1 | endpt1 | TG + TT | 44 | 518 | 70 | 459 |
| hCV598677 | rs5370 | EDN1 | endpt1 | GG | 89 | 774 | 93 | 759 |
| hCV7441704 | rs1800205 | PPT1 | endpt1 | GA + GG | 7 | 118 | 18 | 109 |
| hCV7441704 | rs1800205 | PPT1 | endpt1 | AA | 125 | 1169 | 147 | 1107 |
| hCV7443062 | rs897453 | PEMT | endpt1 | TC + TT | 102 | 897 | 107 | 865 |
| hCV7443062 | rs897453 | PEMT | endpt1 | CC | 31 | 395 | 57 | 350 |
| hCV7475492 | rs1138469 | HSPG2 | endpt1 | TC + TT | 23 | 156 | 22 | 185 |
| hCV7475492 | rs1138469 | HSPG2 | endpt1 | CC | 109 | 1132 | 142 | 1026 |
| hCV7490135 | rs1805082 | NPC1 | endpt1 | CT + CC | 85 | 924 | 126 | 866 |
| hCV7490135 | rs1805082 | NPC1 | endpt1 | TT | 48 | 363 | 39 | 345 |
| hCV7494810 | rs1058587 | GDF15 | endpt1 | GC + GG | 46 | 559 | 80 | 517 |
| hCV7494810 | rs1058587 | GDF15 | endpt1 | CC | 86 | 730 | 85 | 697 |

TABLE 21-continued

CHD Risk Reduction by Pravastatin in CARE According to SNP Genotypes

| | | | | | | | | |
|---|---|---|---|---|---|---|---|---|
| hCV7499212 | rs1800127 | LRP1 | endpt1 | TC + TT | 5 | 63 | 14 | 56 |
| hCV7499212 | rs1800127 | LRP1 | endpt1 | CC | 128 | 1229 | 151 | 1158 |
| hCV7514879 | rs1800629 | | endpt1 | AG + AA | 33 | 403 | 55 | 361 |
| hCV7514879 | rs1800629 | | endpt1 | GG | 100 | 885 | 110 | 855 |
| hCV7577801 | rs11876 | SLC9A3R2 | endpt1 | TC + TT | 56 | 491 | 48 | 468 |
| hCV7577801 | rs11876 | SLC9A3R2 | endpt1 | CC | 77 | 798 | 117 | 741 |
| hCV7618856 | rs1143675 | ITGA4 | endpt1 | CT + CC | 4 | 19 | 1 | 33 |
| hCV7618856 | rs1143675 | ITGA4 | endpt1 | TT | 127 | 1264 | 163 | 1182 |
| hCV783138 | rs6046 | F10 | endpt1 | AG + AA | 31 | 258 | 24 | 242 |
| hCV783138 | rs6046 | F10 | endpt1 | GG | 101 | 1033 | 139 | 972 |
| hCV783184 | rs510335 | | endpt1 | TG + TT | 32 | 282 | 27 | 273 |
| hCV783184 | rs510335 | | endpt1 | GG | 100 | 1008 | 137 | 942 |
| hCV7841642 | rs11666735 | FCAR | endpt1 | AG + AA | 13 | 183 | 30 | 169 |
| hCV7841642 | rs11666735 | FCAR | endpt1 | GG | 120 | 1108 | 135 | 1048 |
| hCV7900503 | rs3732379 | CX3CR1 | endpt1 | TC + TT | 65 | 614 | 68 | 616 |
| hCV7900503 | rs3732379 | CX3CR1 | endpt1 | CC | 68 | 677 | 97 | 600 |
| hCV795441 | rs401502 | IL12RB1 | endpt1 | GC + GG | 81 | 690 | 79 | 649 |
| hCV795441 | rs401502 | IL12RB1 | endpt1 | CC | 52 | 596 | 86 | 565 |
| hCV795442 | rs375947 | IL12RB1 | endpt1 | GA + GG | 80 | 691 | 77 | 651 |
| hCV795442 | rs375947 | IL12RB1 | endpt1 | AA | 52 | 599 | 87 | 566 |
| hCV8705506 | rs5516 | KLK1 | endpt1 | CG + CC | 66 | 749 | 96 | 667 |
| hCV8705506 | rs5516 | KLK1 | endpt1 | GG | 67 | 543 | 69 | 550 |
| hCV8708474 | rs1800468 | MGC4093 | endpt1 | TC + TT | 30 | 212 | 23 | 194 |
| hCV8708474 | rs1800468 | MGC4093 | endpt1 | CC | 103 | 1068 | 142 | 1013 |
| hCV8718197 | rs1050998 | CXCL16 | endpt1 | GA + GG | 98 | 879 | 100 | 842 |
| hCV8718197 | rs1050998 | CXCL16 | endpt1 | AA | 33 | 409 | 65 | 376 |
| hCV8726337 | rs5498 | ICAM1 | endpt1 | GA + GG | 102 | 857 | 111 | 851 |
| hCV8726337 | rs5498 | ICAM1 | endpt1 | AA | 31 | 430 | 53 | 365 |
| hCV8848630 | rs7192 | HLA-DRA | endpt1 | TG + TT | 74 | 802 | 106 | 737 |
| hCV8848630 | rs7192 | HLA-DRA | endpt1 | GG | 59 | 485 | 58 | 477 |
| hCV8851085 | rs1042153 | HLA-DPB1 | endpt1 | AG + AA | 58 | 491 | 58 | 484 |
| hCV8851085 | rs1042153 | HLA-DPB1 | endpt1 | GG | 74 | 798 | 106 | 731 |
| hCV8895373 | rs1503185 | PTPRJ | endpt1 | AG + AA | 53 | 409 | 44 | 394 |
| hCV8895373 | rs1503185 | PTPRJ | endpt1 | GG | 80 | 882 | 120 | 820 |
| hCV8901525 | rs861539 | KLC1 | endpt1 | AG + AA | 88 | 759 | 86 | 734 |
| hCV8901525 | rs861539 | KLC1 | endpt1 | GG | 45 | 504 | 75 | 457 |
| hCV8921288 | rs1060621 | GAPDH | endpt1 | CA + CC | 36 | 440 | 73 | 403 |
| hCV8921288 | rs1060621 | GAPDH | endpt1 | AA | 97 | 815 | 85 | 786 |
| hCV904973 | rs7412 | APOE | endpt1 | TC + TT | 19 | 141 | 11 | 135 |
| hCV904973 | rs7412 | APOE | endpt1 | CC | 114 | 1149 | 154 | 1081 |
| hCV9077561 | rs1801274 | FCGR2A | endpt1 | GA + GG | 96 | 985 | 133 | 891 |
| hCV9077561 | rs1801274 | FCGR2A | endpt1 | AA | 36 | 300 | 32 | 325 |
| hCV9494470 | | | endpt1 | TG + TT | 33 | 407 | 54 | 365 |
| hCV9494470 | | | endpt1 | GG | 100 | 884 | 111 | 851 |
| hCV9506149 | rs1250259 | FN1 | endpt1 | TA + TT | 69 | 611 | 68 | 582 |
| hCV9506149 | rs1250259 | FN1 | endpt1 | AA | 64 | 678 | 97 | 634 |
| hCV9604851 | rs1805002 | CCKBR | endpt1 | AG + AA | 19 | 113 | 14 | 140 |
| hCV9604851 | rs1805002 | CCKBR | endpt1 | GG | 114 | 1178 | 151 | 1075 |
| hCV2553030 | rs11230562 | CD6 | endpt1 | TC + CC | 129 | 1179 | 154 | 1151 |
| hCV2553030 | rs11230562 | CD6 | endpt1 | TT | 3 | 107 | 11 | 63 |
| hCV25637309 | rs3204849 | CCRL2 | endpt1 | AT + TT | 109 | 1107 | 150 | 994 |
| hCV25637309 | rs3204849 | CCRL2 | endpt1 | AA | 24 | 184 | 15 | 219 |
| hCV25640504 | | | endpt1 | TC + CC | 113 | 1035 | 128 | 977 |
| hCV25640504 | | | endpt1 | TT | 12 | 194 | 28 | 175 |
| hCV2769554 | rs1805010 | IL4R | endpt1 | GA + AA | 101 | 1001 | 144 | 939 |
| hCV2769554 | rs1805010 | IL4R | endpt1 | GG | 32 | 287 | 21 | 274 |
| hCV2822674 | rs1801222 | CUBN | endpt1 | AG + GG | 123 | 1140 | 144 | 1097 |
| hCV2822674 | rs1801222 | CUBN | endpt1 | AA | 10 | 150 | 21 | 117 |
| hCV2992252 | rs6037651 | SIGLEC1 | endpt1 | CT + TT | 124 | 1089 | 140 | 1019 |
| hCV2992252 | rs6037651 | SIGLEC1 | endpt1 | CC | 8 | 196 | 25 | 193 |
| hCV3187716 | rs5186 | AGTR1 | endpt1 | CA + AA | 128 | 1176 | 143 | 1093 |
| hCV3187716 | rs5186 | AGTR1 | endpt1 | CC | 5 | 112 | 22 | 118 |
| hCV3215409 | rs267561 | ITGA9 | endpt1 | GA + AA | 118 | 1057 | 128 | 994 |
| hCV3215409 | rs267561 | ITGA9 | endpt1 | GG | 15 | 235 | 37 | 222 |
| hCV3219460 | rs1799983 | NOS3 | endpt1 | TG + GG | 124 | 1114 | 144 | 1065 |
| hCV3219460 | rs1799983 | NOS3 | endpt1 | TT | 9 | 177 | 21 | 149 |
| hCV370782 | rs9841174 | SERPINI2 | endpt1 | CT + TT | 113 | 1097 | 150 | 1022 |
| hCV370782 | rs9841174 | SERPINI2 | endpt1 | CC | 20 | 194 | 15 | 189 |
| hCV7514870 | rs1041981 | LTA | endpt1 | AC + CC | 121 | 1118 | 144 | 1094 |
| hCV7514870 | rs1041981 | LTA | endpt1 | AA | 12 | 172 | 21 | 122 |
| hCV818008 | rs5918 | ITGB3 | endpt1 | CT + TT | 126 | 1266 | 164 | 1194 |
| hCV818008 | rs5918 | ITGB3 | endpt1 | CC | 7 | 26 | 1 | 22 |
| hCV8708473 | rs1800469 | TMEM91 | endpt1 | AG + GG | 124 | 1153 | 145 | 1090 |
| hCV8708473 | rs1800469 | TMEM91 | endpt1 | AA | 9 | 139 | 20 | 125 |
| hCV8709053 | rs4880 | SOD2 | endpt1 | GA + AA | 105 | 954 | 117 | 928 |
| hCV8709053 | rs4880 | SOD2 | endpt1 | GG | 28 | 335 | 47 | 285 |
| hCV8737990 | rs419598 | IL1RN | endpt1 | CT + TT | 117 | 1193 | 157 | 1104 |
| hCV8737990 | rs419598 | IL1RN | endpt1 | CC | 15 | 96 | 8 | 103 |

TABLE 21-continued

CHD Risk Reduction by Pravastatin in CARE According to SNP Genotypes

| | | | | | | | | |
|---|---|---|---|---|---|---|---|---|
| hCV8784787 | rs688976 | | endpt1 | AC + CC | 126 | 1234 | 163 | 1147 |
| hCV8784787 | rs688976 | | endpt1 | AA | 6 | 57 | 2 | 69 |
| hCV8804621 | rs1390938 | SLC18A1 | endpt1 | AG + GG | 125 | 1218 | 160 | 1132 |
| hCV8804621 | rs1390938 | SLC18A1 | endpt1 | AA | 8 | 69 | 4 | 80 |
| hCV8851047 | rs45614833 | HLA-DPA1 | endpt1 | CT + TT | 126 | 1229 | 158 | 1152 |
| hCV8851047 | rs45614833 | HLA-DPA1 | endpt1 | CC | 7 | 32 | 1 | 37 |
| hCV8851065 | rs9277343 | HLA-DPA1 | endpt1 | GC + CC | 120 | 1198 | 158 | 1120 |
| hCV8851065 | rs9277343 | HLA-DPA1 | endpt1 | GG | 13 | 90 | 7 | 98 |
| hCV8851095 | rs1042335 | HLA-DPB1 | endpt1 | TC + CC | 126 | 1216 | 157 | 1139 |
| hCV8851095 | rs1042335 | HLA-DPB1 | endpt1 | TT | 7 | 40 | 4 | 50 |
| hCV9055799 | rs3734311 | IMPG1 | endpt1 | CG + GG | 117 | 1040 | 142 | 1049 |
| hCV9055799 | rs3734311 | IMPG1 | endpt1 | CC | 15 | 247 | 23 | 166 |
| hCV9596963 | rs6115 | SERPINA5 | endpt1 | GA + AA | 106 | 1147 | 151 | 1098 |
| hCV9596963 | rs6115 | SERPINA5 | endpt1 | GG | 26 | 136 | 14 | 117 |
| hCV997884 | rs512770 | | endpt1 | AG + GG | 126 | 1241 | 162 | 1143 |
| hCV997884 | rs512770 | | endpt1 | AA | 5 | 42 | 2 | 63 |
| hCV2983036 | rs9527025 | KL | endpt1 | CC | 4 | 22 | 2 | 27 |
| hCV2983036 | rs9527025 | KL | endpt1 | CG | 32 | 363 | 51 | 293 |
| hCV2983036 | rs9527025 | KL | endpt1 | GG | 97 | 906 | 112 | 891 |
| hCV3135085 | rs10795446 | CUBN | endpt1 | GG | 10 | 147 | 21 | 145 |
| hCV3135085 | rs10795446 | CUBN | endpt1 | GT | 64 | 554 | 61 | 532 |
| hCV3135085 | rs10795446 | CUBN | endpt1 | TT | 57 | 575 | 82 | 529 |
| hCV3275199 | rs2069885 | IL9 | endpt1 | AA | 5 | 28 | 2 | 21 |
| hCV3275199 | rs2069885 | IL9 | endpt1 | AG | 18 | 310 | 35 | 257 |
| hCV3275199 | rs2069885 | IL9 | endpt1 | GG | 109 | 947 | 128 | 937 |
| hCV342590 | rs6030 | F5 | endpt1 | CC | 15 | 123 | 13 | 130 |
| hCV342590 | rs6030 | F5 | endpt1 | CT | 44 | 553 | 74 | 519 |
| hCV342590 | rs6030 | F5 | endpt1 | TT | 74 | 613 | 78 | 566 |
| hCV435368 | rs2812 | PECAM1 | endpt1 | TT | 40 | 272 | 44 | 270 |
| hCV435368 | rs2812 | PECAM1 | endpt1 | TC | 56 | 649 | 86 | 573 |
| hCV435368 | rs2812 | PECAM1 | endpt1 | CC | 37 | 369 | 34 | 373 |
| hCV11170747 | rs2066853 | AHR | endpt1 | GG | 112 | 1008 | 128 | 982 |
| hCV11170747 | rs2066853 | AHR | endpt1 | AG + AA | 20 | 283 | 36 | 235 |
| hCV11181829 | rs5713 | ACSM3 | endpt1 | TT | 124 | 1259 | 161 | 1189 |
| hCV11181829 | rs5713 | ACSM3 | endpt1 | CT + CC | 8 | 23 | 4 | 26 |
| hCV11225994 | rs1853021 | LPA | endpt1 | GG | 92 | 973 | 130 | 894 |
| hCV11225994 | rs1853021 | LPA | endpt1 | AG + AA | 37 | 311 | 34 | 314 |
| hCV11438723 | rs1877273 | WWOX | endpt1 | TT | 0 | 12 | 3 | 13 |
| hCV11438723 | rs1877273 | WWOX | endpt1 | TC + CC | 133 | 1270 | 162 | 1194 |
| hCV11461296 | | JAK3 | endpt1 | GG | 125 | 1204 | 155 | 1153 |
| hCV11461296 | | JAK3 | endpt1 | CG + CC | 1 | 49 | 9 | 36 |
| hCV11628130 | rs2665802 | GH1 | endpt1 | TT | 18 | 254 | 33 | 212 |
| hCV11628130 | rs2665802 | GH1 | endpt1 | TA + AA | 113 | 1034 | 130 | 1001 |
| hCV11642651 | rs1800440 | C2orf58 | endpt1 | CC | 3 | 54 | 10 | 43 |
| hCV11642651 | rs1800440 | C2orf58 | endpt1 | CT + TT | 130 | 1237 | 155 | 1171 |
| hCV11689916 | | | endpt1 | AA | 35 | 369 | 56 | 340 |
| hCV11689916 | | | endpt1 | AT + TT | 97 | 863 | 102 | 816 |
| hCV11697322 | rs1926447 | CPB2 | endpt1 | GG | 59 | 655 | 93 | 616 |
| hCV11697322 | rs1926447 | CPB2 | endpt1 | AG + AA | 74 | 632 | 72 | 600 |
| hCV11764545 | rs4961 | ADD1 | endpt1 | TT | 2 | 52 | 7 | 41 |
| hCV11764545 | rs4961 | ADD1 | endpt1 | TG + GG | 131 | 1238 | 158 | 1176 |
| hCV11955747 | rs9901673 | CD68 | endpt1 | CC | 103 | 891 | 115 | 874 |
| hCV11955747 | rs9901673 | CD68 | endpt1 | AC + AA | 30 | 399 | 50 | 341 |
| hCV11972326 | rs5988 | F13A1 | endpt1 | GG | 13 | 69 | 8 | 80 |
| hCV11972326 | rs5988 | F13A1 | endpt1 | GC + CC | 120 | 1217 | 156 | 1133 |
| hCV12020339 | rs4531 | DBH | endpt1 | GG | 104 | 1095 | 145 | 1035 |
| hCV12020339 | rs4531 | DBH | endpt1 | TG + TT | 28 | 192 | 20 | 174 |
| hCV12108469 | | CYP4A11 | endpt1 | AA | 2 | 60 | 10 | 56 |
| hCV12108469 | | CYP4A11 | endpt1 | AG + GG | 128 | 1225 | 155 | 1148 |
| hCV1243283 | rs1716 | ITGAE | endpt1 | AA | 10 | 151 | 23 | 113 |
| hCV1243283 | rs1716 | ITGAE | endpt1 | AG + GG | 123 | 1138 | 142 | 1101 |
| hCV1253630 | rs2071307 | ELN | endpt1 | GG | 40 | 450 | 66 | 396 |
| hCV1253630 | rs2071307 | ELN | endpt1 | AG + AA | 92 | 839 | 96 | 813 |
| hCV1345898 | rs2230804 | CHUK | endpt1 | CC | 21 | 322 | 38 | 281 |
| hCV1345898 | rs2230804 | CHUK | endpt1 | CT + TT | 111 | 964 | 127 | 930 |
| hCV1361979 | rs25683 | ACAT2 | endpt1 | GG | 36 | 434 | 61 | 384 |
| hCV1361979 | rs25683 | ACAT2 | endpt1 | AG + AA | 97 | 851 | 104 | 820 |
| hCV1375141 | rs1881420 | ALK | endpt1 | CC | 10 | 69 | 6 | 61 |
| hCV1375141 | rs1881420 | ALK | endpt1 | CT | 33 | 421 | 60 | 399 |
| hCV1375141 | rs1881420 | ALK | endpt1 | TT | 90 | 799 | 99 | 757 |
| hCV1552894 | rs434473 | ALOX12 | endpt1 | GG | 16 | 212 | 43 | 222 |
| hCV1552894 | rs434473 | ALOX12 | endpt1 | GA + AA | 116 | 1073 | 122 | 990 |
| hCV1552900 | rs1126667 | ALOX12 | endpt1 | AA | 16 | 212 | 43 | 223 |
| hCV1552900 | rs1126667 | ALOX12 | endpt1 | AG + GG | 117 | 1076 | 122 | 991 |
| hCV15746640 | rs41271951 | CTSS | endpt1 | AA | 109 | 1096 | 150 | 1021 |
| hCV15746640 | rs41271951 | CTSS | endpt1 | GA + GG | 24 | 194 | 15 | 193 |
| hCV15758290 | rs6716834 | LRP2 | endpt1 | AA | 58 | 635 | 87 | 563 |
| hCV15758290 | rs6716834 | LRP2 | endpt1 | GA + GG | 75 | 648 | 78 | 646 |

TABLE 21-continued

CHD Risk Reduction by Pravastatin in CARE According to SNP Genotypes

| | | | | | | | | |
|---|---|---|---|---|---|---|---|---|
| hCV15760070 | rs2308911 | HLA-DPA1 | endpt1 | TT | 7 | 31 | 1 | 38 |
| hCV15760070 | rs2308911 | HLA-DPA1 | endpt1 | TA + AA | 126 | 1258 | 164 | 1179 |
| hCV15851335 | rs17610395 | CPT1A | endpt1 | CC | 111 | 1123 | 147 | 1039 |
| hCV15851335 | rs17610395 | CPT1A | endpt1 | TC + TT | 21 | 164 | 17 | 176 |
| hCV15851779 | rs2230009 | WRN | endpt1 | AA | 0 | 6 | 2 | 4 |
| hCV15851779 | rs2230009 | WRN | endpt1 | AG | 20 | 132 | 14 | 129 |
| hCV15851779 | rs2230009 | WRN | endpt1 | GG | 113 | 1150 | 149 | 1082 |
| hCV15876011 | rs2228541 | SERPINA6 | endpt1 | GG | 35 | 261 | 24 | 239 |
| hCV15876011 | rs2228541 | SERPINA6 | endpt1 | GT + TT | 96 | 991 | 137 | 951 |
| hCV15954277 | rs2236379 | PRKCQ | endpt1 | AA | 13 | 103 | 3 | 92 |
| hCV15954277 | rs2236379 | PRKCQ | endpt1 | AG + GG | 120 | 1188 | 162 | 1126 |
| hCV15955388 | rs2227376 | F2RL3 | endpt1 | CC | 132 | 1247 | 157 | 1173 |
| hCV15955388 | rs2227376 | F2RL3 | endpt1 | TC + TT | 1 | 42 | 8 | 42 |
| hCV15963535 | rs2228591 | NCOA2 | endpt1 | CC | 124 | 1155 | 142 | 1087 |
| hCV15963535 | rs2228591 | NCOA2 | endpt1 | GC + GG | 8 | 132 | 23 | 130 |
| hCV1600754 | rs17288671 | CXCL9 | endpt1 | CC | 34 | 396 | 51 | 324 |
| hCV1600754 | rs17288671 | CXCL9 | endpt1 | TC + TT | 99 | 892 | 114 | 893 |
| hCV1603697 | rs2229475 | HSPG2 | endpt1 | CC | 122 | 1141 | 142 | 1083 |
| hCV1603697 | rs2229475 | HSPG2 | endpt1 | TC + TT | 11 | 148 | 23 | 132 |
| hCV16044337 | rs2569491 | KLK14 | endpt1 | AA | 7 | 127 | 26 | 114 |
| hCV16044337 | rs2569491 | KLK14 | endpt1 | AG + GG | 126 | 1157 | 138 | 1095 |
| hCV16047108 | rs2244008 | LAMA2 | endpt1 | AA | 104 | 1148 | 145 | 1062 |
| hCV16047108 | rs2244008 | LAMA2 | endpt1 | GA + GG | 28 | 140 | 20 | 151 |
| hCV16172339 | rs2229489 | HSPG2 | endpt1 | PA | 121 | 1140 | 141 | 1081 |
| hCV16172339 | rs2229489 | HSPG2 | endpt1 | TA + TT | 11 | 147 | 23 | 131 |
| hCV16173091 | rs2241883 | FABP1 | endpt1 | CC | 18 | 126 | 10 | 136 |
| hCV16173091 | rs2241883 | FABP1 | endpt1 | CT + TT | 115 | 1164 | 155 | 1080 |
| hCV16179493 | rs2106622 | CYP4F2 | endpt1 | CC | 54 | 613 | 90 | 574 |
| hCV16179493 | rs2108622 | CYP4F2 | endpt1 | TC + TT | 77 | 670 | 75 | 640 |
| hCV16179628 | rs2273697 | ABCC2 | endpt1 | AA | 1 | 68 | 4 | 28 |
| hCV16179628 | rs2273697 | ABCC2 | endpt1 | AG + GG | 132 | 1220 | 161 | 1189 |
| hCV16182835 | rs2274736 | PTPN21 | endpt1 | AA | 70 | 555 | 62 | 511 |
| hCV16182835 | rs2274736 | PTPN21 | endpt1 | GA + GG | 62 | 703 | 98 | 684 |
| hCV16192174 | rs2305948 | KDR | endpt1 | GG | 96 | 1043 | 134 | 984 |
| hCV16192174 | rs2305948 | KDR | endpt1 | AG + AA | 37 | 248 | 31 | 232 |
| hCV1647371 | rs3025000 | VEGFA | endpt1 | CC | 57 | 600 | 88 | 529 |
| hCV1647371 | rs3025000 | VEGFA | endpt1 | TC + TT | 75 | 662 | 73 | 664 |
| hCV1741111 | rs1764391 | C1orf212 | endpt1 | TT | 12 | 114 | 6 | 97 |
| hCV1741111 | rs1764391 | C1orf212 | endpt1 | TC + CC | 121 | 1174 | 159 | 1118 |
| hCV1770462 | rs12731981 | MPL | endpt1 | GG | 114 | 1204 | 153 | 1141 |
| hCV1770462 | rs12731981 | MPL | endpt1 | AG + AA | 18 | 82 | 12 | 76 |
| hCV1843175 | rs3745535 | KLK10 | endpt1 | CC | 57 | 528 | 59 | 538 |
| hCV1843175 | rs3745535 | KLK10 | endpt1 | AC + AA | 75 | 754 | 106 | 675 |
| hCV2038 | rs4673 | CYBA | endpt1 | GG | 44 | 563 | 76 | 520 |
| hCV2038 | rs4673 | CYBA | endpt1 | AG + AA | 89 | 728 | 89 | 697 |
| hCV2143205 | rs9666607 | CD44 | endpt1 | AA | 16 | 125 | 9 | 119 |
| hCV2143205 | rs9666607 | CD44 | endpt1 | AG + GG | 117 | 1167 | 156 | 1099 |
| hCV22271999 | rs2305948 | KDR | endpt1 | CC | 96 | 1041 | 133 | 981 |
| hCV22271999 | rs2305946 | KDR | endpt1 | TC + TT | 37 | 248 | 31 | 230 |
| hCV22274761 | rs11575194 | IGFBP5 | endpt1 | GG | 126 | 1175 | 149 | 1113 |
| hCV22274761 | rs11575194 | IGFBP5 | endpt1 | AG + AA | 6 | 108 | 16 | 100 |
| hCV22275550 | rs6836335 | SPON2 | endpt1 | CC | 3 | 15 | 1 | 26 |
| hCV22275550 | rs6836335 | SPON2 | endpt1 | CT + TT | 129 | 1270 | 164 | 1189 |
| hCV2230606 | rs13268 | FBLN1 | endpt1 | AA | 124 | 1224 | 161 | 1153 |
| hCV2230606 | rs13268 | FBLN1 | endpt1 | GA + GG | 9 | 62 | 3 | 63 |
| hCV2276802 | rs381418 | GBA | endpt1 | AA | 33 | 354 | 54 | 313 |
| hCV2276802 | rs381418 | GBA | endpt1 | CA + CC | 100 | 935 | 110 | 903 |
| hCV2310409 | 45474794-rs6 | APOA4 | endpt1 | TT | 76 | 825 | 107 | 756 |
| hCV2310409 | 45474794-rs6 | APOA4 | endpt1 | AT + AA | 56 | 459 | 56 | 450 |
| hCV2485037 | rs4904448 | SPATA7 | endpt1 | AA | 31 | 228 | 23 | 219 |
| hCV2485037 | rs4904448 | SPATA7 | endpt1 | AG + GG | 101 | 1032 | 137 | 965 |
| hCV2503034 | rs1132356 | BAIAP3 | endpt1 | AA | 0 | 16 | 3 | 4 |
| hCV2503034 | rs1132356 | BAIAP3 | endpt1 | AC | 34 | 258 | 35 | 219 |
| hCV2503034 | rs1132356 | BAIAP3 | endpt1 | CC | 97 | 1010 | 126 | 985 |
| hCV2531086 | rs10406069 | CD22 | endpt1 | AA | 7 | 52 | 2 | 47 |
| hCV2531086 | rs10406069 | CD22 | endpt1 | AG + GG | 124 | 1236 | 163 | 1167 |
| hCV2536595 | rs704 | VTN | endpt1 | GG | 44 | 351 | 34 | 381 |
| hCV2536595 | rs704 | VTN | endpt1 | AG + AA | 89 | 940 | 131 | 837 |
| hCV25472345 | rs4900072 | C14orf159 | endpt1 | TT | 8 | 154 | 29 | 160 |
| hCV25472345 | rs4900072 | C14orf159 | endpt1 | TC + CC | 124 | 1108 | 130 | 1029 |
| hCV25472673 | rs1805081 | NPC1 | endpt1 | TT | 59 | 484 | 47 | 455 |
| hCV25472673 | rs1805081 | NPC1 | endpt1 | CT + CC | 74 | 803 | 117 | 761 |
| hCV25473098 | rs2241883 | FABP1 | endpt1 | GG | 18 | 124 | 11 | 137 |
| hCV25473098 | rs2241883 | FABP1 | endpt1 | GA + AA | 115 | 1165 | 152 | 1071 |
| hCV25474101 | rs41554412 | MICA | endpt1 | CC | 7 | 25 | 2 | 32 |
| hCV25474101 | rs41554412 | MICA | endpt1 | CT + TT | 126 | 1266 | 163 | 1184 |
| hCV25591528 | | CD163 | endpt1 | GG | 114 | 994 | 128 | 956 |
| hCV25591528 | | CD163 | endpt1 | AG + AA | 19 | 296 | 37 | 262 |

TABLE 21-continued

CHD Risk Reduction by Pravastatin in CARE According to SNP Genotypes

| | | | | | | | | |
|---|---|---|---|---|---|---|---|---|
| hCV25596880 | rs4647297 | CASP2 | endpt1 | CC | 2 | 3 | 0 | 6 |
| hCV25596880 | rs4647297 | CASP2 | endpt1 | CG | 12 | 136 | 12 | 137 |
| hCV25596880 | rs4647297 | CASP2 | endpt1 | GG | 118 | 1150 | 153 | 1072 |
| hCV25598594 | rs41274768 | CR1 | endpt1 | GG | 132 | 1226 | 154 | 1167 |
| hCV25598594 | rs41274768 | CR1 | endpt1 | AG + AA | 1 | 65 | 11 | 50 |
| hCV25603879 | rs11542844 | SCNN1A | endpt1 | CC | 122 | 1200 | 160 | 1126 |
| hCV25603879 | rs11542844 | SCNN1A | endpt1 | TC + TT | 11 | 89 | 5 | 85 |
| hCV25605897 | rs11568563 | SLCO1A2 | endpt1 | TT | 126 | 1140 | 144 | 1088 |
| hCV25605897 | rs11568563 | SLCO1A2 | endpt1 | GT + GG | 7 | 150 | 20 | 126 |
| hCV25607193 | | FLNB | endpt1 | TT | 127 | 1258 | 164 | 1191 |
| hCV25607193 | | FLNB | endpt1 | CT + CC | 6 | 33 | 1 | 27 |
| hCV25608818 | | SLC10A2 | endpt1 | GG | 126 | 1258 | 162 | 1176 |
| hCV25608818 | | SLC10A2 | endpt1 | AG + AA | 7 | 32 | 2 | 40 |
| hCV25610470 | rs34075341 | C9orf47 | endpt1 | GG | 128 | 1182 | 151 | 1128 |
| hCV25610470 | rs34075341 | C9orf47 | endpt1 | AG + AA | 4 | 103 | 13 | 87 |
| hCV25610774 | rs8176748 | | endpt1 | TT | 5 | 57 | 2 | 67 |
| hCV25610774 | rs8176748 | | endpt1 | TC + CC | 127 | 1231 | 163 | 1150 |
| hCV25610819 | rs8176740 | | endpt1 | TT | 5 | 58 | 2 | 70 |
| hCV25610819 | rs8176740 | | endpt1 | TA + AA | 128 | 1225 | 163 | 1139 |
| hCV25614016 | rs7607759 | CAPN10 | endpt1 | AA | 87 | 915 | 130 | 840 |
| hCV25614016 | rs7607759 | CAPN10 | endpt1 | GA + GG | 46 | 374 | 35 | 374 |
| hCV25617571 | rs2232580 | LBP | endpt1 | CC | 117 | 1090 | 132 | 1052 |
| hCV25617571 | rs2232580 | LBP | endpt1 | TC + TT | 16 | 200 | 33 | 165 |
| hCV25623265 | rs3746638 | SIGLEC1 | endpt1 | GG | 14 | 288 | 40 | 279 |
| hCV25623265 | rs3746638 | SIGLEC1 | endpt1 | GA + AA | 118 | 1000 | 125 | 936 |
| hCV25629396 | rs3729823 | MYH7 | endpt1 | GG | 125 | 1260 | 163 | 1166 |
| hCV25629396 | rs3729823 | MYH7 | endpt1 | CG + CC | 7 | 26 | 1 | 48 |
| hCV25629476 | rs2427284 | LAMA5 | endpt1 | GG | 111 | 1158 | 150 | 1095 |
| hCV25629476 | rs2427284 | LAMA5 | endpt1 | AG + AA | 22 | 131 | 14 | 121 |
| hCV25629492 | rs944895 | LAMA5 | endpt1 | AA | 66 | 511 | 71 | 513 |
| hCV25629492 | rs944895 | LAMA5 | endpt1 | GA + GG | 64 | 773 | 94 | 696 |
| hCV25629888 | rs11539441 | TIMP2 | endpt1 | GG | 7 | 30 | 3 | 34 |
| hCV25629888 | rs11539441 | TIMP2 | endpt1 | GC + CC | 125 | 1261 | 161 | 1184 |
| hCV25652744 | rs1127525 | USP21 | endpt1 | AA | 1 | 0 | 0 | 4 |
| hCV25652744 | rs1127525 | USP21 | endpt1 | AC | 5 | 113 | 15 | 107 |
| hCV25652744 | rs1127525 | USP21 | endpt1 | CC | 127 | 1153 | 145 | 1082 |
| hCV1026586 | rs673548 | APOB | endpt1 | GA + GG | 127 | 1203 | 163 | 1147 |
| hCV1026586 | rs673548 | APOB | endpt1 | AA | 9 | 59 | 4 | 58 |
| hCV11466848 | rs1805419 | BAX | endpt1 | AG + AA | 53 | 620 | 93 | 563 |
| hCV11466848 | rs1805419 | BAX | endpt1 | GG | 83 | 645 | 74 | 643 |
| hCV11513719 | rs2967605 | ELAVL1 | endpt1 | TC + TT | 40 | 425 | 67 | 372 |
| hCV11513719 | rs2967605 | ELAVL1 | endpt1 | CC | 95 | 832 | 99 | 829 |
| hCV1323634 | rs287475 | | endpt1 | TC + TT | 106 | 1034 | 149 | 980 |
| hCV1323634 | rs287475 | | endpt1 | CC | 30 | 229 | 18 | 225 |
| hCV1323669 | rs287354 | | endpt1 | GA + GG | 104 | 1023 | 144 | 968 |
| hCV1323669 | rs287354 | | endpt1 | AA | 32 | 244 | 22 | 239 |
| hCV1729928 | rs10509384 | KCNMA1 | endpt1 | AG + AA | 117 | 1119 | 153 | 1043 |
| hCV1729928 | rs10509384 | KCNMA1 | endpt1 | GG | 18 | 142 | 14 | 158 |
| hCV1948599 | rs504527 | CSMD2 | endpt1 | CA + CC | 92 | 989 | 129 | 920 |
| hCV1948599 | rs504527 | CSMD2 | endpt1 | AA | 44 | 275 | 38 | 283 |
| hCV2554615 | rs2522057 | LOC441108 | endpt1 | CG + CC | 107 | 1046 | 146 | 998 |
| hCV2554615 | rs2522057 | LOC441108 | endpt1 | GG | 29 | 216 | 20 | 208 |
| hCV2554721 | rs7315519 | RPH3A | endpt1 | AG + AA | 84 | 911 | 130 | 844 |
| hCV2554721 | rs7315519 | RPH3A | endpt1 | GG | 52 | 355 | 37 | 361 |
| hCV260164 | rs6754295 | | endpt1 | TG + TT | 127 | 1195 | 163 | 1138 |
| hCV260164 | rs6754295 | | endpt1 | GG | 9 | 68 | 4 | 68 |
| hCV2762168 | rs3939286 | | endpt1 | TC + TT | 62 | 592 | 91 | 531 |
| hCV2762168 | rs3939286 | | endpt1 | CC | 74 | 673 | 76 | 673 |
| hCV2781953 | rs6021931 | | endpt1 | GT + GG | 127 | 1214 | 161 | 1158 |
| hCV2781953 | rs6021931 | | endpt1 | TT | 9 | 49 | 4 | 46 |
| hCV29011391 | rs7557067 | | endpt1 | AG + AA | 126 | 1191 | 163 | 1139 |
| hCV29011391 | rs7557067 | | endpt1 | GG | 9 | 69 | 4 | 67 |
| hCV29135108 | rs6743779 | KLF7 | endpt1 | CA + CC | 61 | 661 | 103 | 633 |
| hCV29135108 | rs6743779 | KLF7 | endpt1 | AA | 74 | 601 | 64 | 572 |
| hCV30264691 | rs10508518 | CUBN | endpt1 | TG + TT | 121 | 1148 | 157 | 1087 |
| hCV30264691 | rs10508518 | CUBN | endpt1 | GG | 15 | 111 | 10 | 116 |
| hCV30606396 | rs10438978 | | endpt1 | TC + TT | 40 | 428 | 62 | 375 |
| hCV30606396 | rs10438978 | | endpt1 | CC | 96 | 834 | 105 | 830 |
| hCV31237961 | rs11950562 | SLC22A4 | endpt1 | AC + AA | 101 | 986 | 143 | 936 |
| hCV31237961 | rs11950562 | SLC22A4 | endpt1 | CC | 35 | 279 | 24 | 268 |
| hCV3168675 | rs469930 | | endpt1 | GA + GG | 77 | 766 | 109 | 709 |
| hCV3168675 | rs469930 | | endpt1 | AA | 59 | 499 | 58 | 495 |
| hCV3170445 | rs272893 | SLC22A4 | endpt1 | TC + TT | 81 | 779 | 121 | 732 |
| hCV3170445 | rs272893 | SLC22A4 | endpt1 | CC | 55 | 487 | 46 | 474 |
| hCV3170459 | rs1050152 | SLC22A4 | endpt1 | CT + CC | 105 | 1038 | 145 | 989 |
| hCV3170459 | rs1050152 | SLC22A4 | endpt1 | TT | 31 | 223 | 22 | 217 |
| hCV3242919 | rs486394 | | endpt1 | AC + AA | 120 | 1158 | 159 | 1110 |
| hCV3242919 | rs486394 | | endpt1 | CC | 16 | 104 | 8 | 96 |

TABLE 21-continued

CHD Risk Reduction by Pravastatin in CARE According to SNP Genotypes

| | | | | | | | | |
|---|---|---|---|---|---|---|---|---|
| hCV3242952 | rs2000571 | | endpt1 | AG + AA | 42 | 464 | 74 | 448 |
| hCV3242952 | rs2000571 | | endpt1 | GG | 94 | 799 | 93 | 757 |
| hCV610861 | rs636887 | | endpt1 | TC + TT | 108 | 1017 | 146 | 973 |
| hCV610861 | rs636887 | | endpt1 | CC | 28 | 247 | 21 | 233 |
| hCV7501549 | rs1467412 | ATP9A | endpt1 | CT + CC | 93 | 947 | 132 | 903 |
| hCV7501549 | rs1467412 | ATP9A | endpt1 | TT | 43 | 319 | 35 | 303 |
| hCV7537517 | rs1501908 | | endpt1 | CG + CC | 117 | 1087 | 156 | 1041 |
| hCV7537517 | rs1501908 | | endpt1 | GG | 19 | 175 | 10 | 165 |
| hCV7910239 | rs1541296 | FVT1 | endpt1 | AG + AA | 118 | 1111 | 152 | 1041 |
| hCV7910239 | rs1541296 | FVT1 | endpt1 | GG | 18 | 147 | 14 | 163 |
| hCV8420416 | rs719909 | PANK1 | endpt1 | CT + CC | 131 | 1236 | 165 | 1164 |
| hCV8420416 | rs719909 | PANK1 | endpt1 | TT | 5 | 26 | 2 | 41 |
| hCV8785827 | rs992969 | IL33 | endpt1 | AG + AA | 61 | 591 | 91 | 527 |
| hCV8785827 | rs992969 | IL33 | endpt1 | GG | 75 | 675 | 76 | 677 |
| hCV8892418 | rs901746 | ACP2 | endpt1 | GA + GG | 53 | 630 | 87 | 593 |
| hCV8892418 | rs901746 | ACP2 | endpt1 | AA | 83 | 632 | 80 | 613 |
| hCV11678789 | rs7219148 | | endpt1 | TG + GG | 111 | 918 | 116 | 905 |
| hCV11678789 | rs7219148 | | endpt1 | TT | 25 | 348 | 51 | 301 |
| hCV11864162 | rs1167998 | DOCK7 | endpt1 | AC + CC | 84 | 692 | 90 | 701 |
| hCV11864162 | rs1167998 | DOCK7 | endpt1 | AA | 52 | 570 | 76 | 504 |
| hCV1239369 | rs275982 | | endpt1 | CA + AA | 88 | 713 | 90 | 698 |
| hCV1239369 | rs275982 | | endpt1 | CC | 48 | 552 | 77 | 508 |
| hCV1488444 | rs10164405 | | endpt1 | TG + GG | 129 | 1159 | 148 | 1096 |
| hCV1488444 | rs10164405 | | endpt1 | TT | 7 | 103 | 19 | 107 |
| hCV1489995 | rs4013819 | LOC392281 | endpt1 | GC + CC | 120 | 1076 | 133 | 1035 |
| hCV1489995 | rs4013819 | LOC392281 | endpt1 | GG | 16 | 185 | 34 | 170 |
| hcV15870728 | rs2943245 | C10orf64 | endpt1 | CT + TT | 106 | 922 | 112 | 868 |
| hCV15870728 | rs2943245 | C10orf64 | endpt1 | CC | 30 | 340 | 55 | 338 |
| hCV1802755 | rs7764347 | RFXDC1 | endpt1 | CT + TT | 134 | 1216 | 158 | 1165 |
| hCV1802755 | rs7764347 | RFXDC1 | endpt1 | CC | 2 | 47 | 9 | 40 |
| hCV2557331 | rs233716 | RPH3A | endpt1 | CT + TT | 118 | 1029 | 133 | 1001 |
| hCV2557331 | rs233716 | RPH3A | endpt1 | CC | 18 | 235 | 33 | 203 |
| hCV2632070 | rs714052 | BAZ1B | endpt1 | AG + GG | 40 | 289 | 30 | 263 |
| hCV2632070 | rs714052 | BAZ1B | endpt1 | AA | 96 | 974 | 137 | 940 |
| hCV2632498 | rs3812316 | MLXIPL | endpt1 | CG + GG | 40 | 297 | 33 | 277 |
| hCV2632498 | rs3812316 | MLXIPL | endpt1 | CC | 96 | 969 | 134 | 929 |
| hCV2632544 | rs17145738 | | endpt1 | CT + TT | 41 | 283 | 31 | 271 |
| hCV2632544 | rs17145738 | | endpt1 | CC | 95 | 983 | 136 | 936 |
| hCV28974083 | rs8032553 | C15orf42 | endpt1 | GA + AA | 105 | 902 | 116 | 899 |
| hCV28974083 | rs8032553 | C15orf42 | endpt1 | GG | 31 | 360 | 51 | 306 |
| hCV31145250 | rs10889353 | DOCK7 | endpt1 | AC + CC | 84 | 685 | 87 | 687 |
| hCV31145250 | rs10889353 | DOCK7 | endpt1 | AA | 52 | 575 | 79 | 519 |
| hCV31528409 | rs7635061 | | endpt1 | AG + GG | 74 | 606 | 74 | 587 |
| hCV31528409 | rs7635061 | | endpt1 | AA | 62 | 659 | 92 | 619 |
| hCV31954792 | rs6477693 | C9orf4 | endpt1 | CA + AA | 129 | 1163 | 148 | 1103 |
| hCV31954792 | rs6477693 | C9orf4 | endpt1 | CC | 7 | 103 | 19 | 101 |
| hCV461035 | rs7746448 | | endpt1 | TC + CC | 89 | 785 | 99 | 796 |
| hCV461035 | rs7746448 | | endpt1 | TT | 47 | 481 | 68 | 410 |
| hCV601961 | rs568654 | ZNF568 | endpt1 | AG + GG | 118 | 1072 | 135 | 1040 |
| hCV601961 | rs568654 | ZNF568 | endpt1 | AA | 18 | 190 | 32 | 166 |
| hCV8785824 | rs1412426 | | endpt1 | AC + CC | 128 | 1137 | 142 | 1080 |
| hCV8785824 | rs1412426 | | endpt1 | AA | 8 | 127 | 25 | 122 |
| hCV9581635 | rs1748195 | DOCK7 | endpt1 | CG + GG | 84 | 687 | 88 | 694 |
| hCV9581635 | rs1748195 | DOCK7 | endpt1 | CC | 52 | 575 | 78 | 511 |
| hCV9586862 | rs995000 | DOCK7 | endpt1 | CT + TT | 84 | 688 | 88 | 683 |
| hCV9586862 | rs995000 | DOCK7 | endpt1 | CC | 52 | 577 | 79 | 523 |
| hDV76976592 | rs4149274 | ABCA1 | endpt1 | GA + AA | 84 | 705 | 83 | 669 |
| hDV76976592 | rs4149274 | ABCA1 | endpt1 | GG | 52 | 557 | 84 | 537 |
| hCV11568668 | rs1317538 | KCNQ5 | endpt1 | AA | 43 | 324 | 49 | 277 |
| hCV11568668 | rs1317538 | KCNQ5 | endpt1 | AG | 70 | 607 | 67 | 603 |
| hCV11568668 | rs1317538 | KCNQ5 | endpt1 | GG | 23 | 336 | 50 | 328 |
| hCV2221541 | rs739161 | | endpt1 | CC | 7 | 121 | 17 | 80 |
| hCV2221541 | rs739161 | | endpt1 | TC | 55 | 492 | 60 | 535 |
| hCV2221541 | rs739161 | | endpt1 | TT | 74 | 649 | 90 | 591 |
| hCV601962 | rs544543 | ZNF568 | endpt1 | AA | 44 | 522 | 66 | 457 |
| hCV601962 | rs544543 | ZNF568 | endpt1 | GA | 71 | 545 | 69 | 579 |
| hCV601962 | rs544543 | ZNF568 | endpt1 | GG | 18 | 191 | 32 | 168 |
| hCV8369472 | rs1447351 | MTNR1B | endpt1 | GG | 42 | 347 | 59 | 322 |
| hCV8369472 | rs1447351 | MTNR1B | endpt1 | GA | 65 | 586 | 65 | 632 |
| hCV8369472 | rs1447351 | MTNR1B | endpt1 | AA | 29 | 330 | 43 | 252 |
| hCV22303 | rs4552916 | | endpt1 | AA | 86 | 788 | 95 | 755 |
| hCV22303 | rs4552916 | | endpt1 | GA | 37 | 408 | 65 | 383 |
| hCV22303 | rs4552916 | | endpt1 | GG | 13 | 70 | 7 | 68 |
| hCV601946 | rs524802 | ZNF568 | endpt1 | AA | 17 | 175 | 29 | 156 |
| hCV601946 | rs524802 | ZNF568 | endpt1 | AG | 74 | 554 | 70 | 578 |
| hCV601946 | rs524802 | ZNF568 | endpt1 | GG | 45 | 536 | 68 | 471 |
| hCV922535 | rs748065 | | endpt1 | AA | 74 | 611 | 76 | 587 |
| hCV922535 | rs748065 | | endpt1 | GA | 48 | 541 | 81 | 520 |

TABLE 21-continued

CHD Risk Reduction by Pravastatin in CARE According to SNP Genotypes

| | | | | | | | | |
|---|---|---|---|---|---|---|---|---|
| hCV922535 | rs748065 | | endpt1 | GG | 14 | 114 | 10 | 98 |
| hDV70797856 | rs17006217 | | endpt1 | CC | 2 | 14 | 0 | 13 |
| hDV70797856 | rs17006217 | | endpt1 | CT | 25 | 255 | 45 | 231 |
| hDV70797856 | rs17006217 | | endpt1 | TT | 109 | 997 | 122 | 962 |
| hCV11856381 | rs2197089 | | rmi | AG + AA | 84 | 1006 | 129 | 970 |
| hCV11856381 | rs2197089 | | rmi | GG | 27 | 279 | 19 | 253 |
| hCV16140621 | rs2156552 | | rmi | AT + AA | 30 | 416 | 53 | 371 |
| hCV16140621 | rs2156552 | | rmi | TT | 81 | 876 | 95 | 854 |
| hCV1682755 | rs9424977 | NEGR1 | rmi | CT + CC | 73 | 941 | 112 | 893 |
| hCV1682755 | rs9424977 | NEGR1 | rmi | TT | 38 | 347 | 36 | 331 |
| hCV27480853 | rs3766430 | SSBP3 | rmi | TC + TT | 81 | 1029 | 124 | 992 |
| hCV27480853 | rs3766430 | SSBP3 | rmi | CC | 30 | 262 | 24 | 233 |
| hCV2948766 | rs4684343 | CNTN4 | rmi | GA + GG | 85 | 1042 | 129 | 1010 |
| hCV2948766 | rs4684343 | CNTN4 | rmi | AA | 25 | 244 | 18 | 213 |
| hCV30534667 | rs4996259 | MAGI2 | rmi | AG + AA | 47 | 667 | 79 | 595 |
| hCV30534667 | rs4996259 | MAGI2 | rmi | GG | 64 | 624 | 69 | 630 |
| hCV30764105 | rs12521915 | ITGA2 | rmi | GC + GG | 57 | 800 | 94 | 727 |
| hCV30764105 | rs12521915 | ITGA2 | rmi | CC | 54 | 491 | 54 | 498 |
| hCV11231076 | rs4857855 | | rmi | CT + TT | 46 | 405 | 42 | 414 |
| hCV11231076 | rs4857855 | | rmi | CC | 65 | 885 | 106 | 809 |
| hCV11466079 | rs157580 | TOMM40 | rmi | GA + AA | 98 | 1081 | 119 | 1029 |
| hCV11466079 | rs157580 | TOMM40 | rmi | GG | 13 | 207 | 29 | 195 |
| hCV11592758 | rs6265 | BDNF | rmi | CT + TT | 48 | 434 | 44 | 407 |
| hCV11592758 | rs6265 | BDNF | rmi | CC | 61 | 880 | 101 | 830 |
| hCV11703905 | rs1169301 | TCF1 | rmi | CT + TT | 67 | 661 | 72 | 632 |
| hCV11703905 | rs1169301 | TCF1 | rmi | CC | 44 | 627 | 76 | 593 |
| hCV2195496 | rs4982795 | | rmi | CT + TT | 92 | 1020 | 112 | 989 |
| hCV2195496 | rs4982795 | | rmi | CC | 18 | 266 | 35 | 234 |
| hCV28960526 | rs6853079 | TSPAN5 | rmi | AT + TT | 51 | 495 | 49 | 494 |
| hCV28960526 | rs6853079 | TSPAN5 | rmi | AA | 60 | 796 | 99 | 732 |
| hCV29480044 | rs10516433 | TSPAN5 | rmi | CT + TT | 51 | 491 | 49 | 494 |
| hCV29480044 | rs10516433 | TSPAN5 | rmi | CC | 60 | 795 | 99 | 733 |
| hCV30136303 | rs6914527 | | rmi | GC + CC | 77 | 797 | 85 | 813 |
| hCV30136303 | rs6914527 | | rmi | GG | 34 | 493 | 63 | 412 |
| hCV30454150 | rs10516434 | TSPAN5 | rmi | CT + TT | 51 | 489 | 49 | 491 |
| hCV30454150 | rs10516434 | TSPAN5 | rmi | CC | 60 | 799 | 99 | 734 |
| hCV487868 | rs6439132 | | rmi | TC + CC | 60 | 573 | 63 | 563 |
| hCV487868 | rs6439132 | | rmi | TT | 51 | 718 | 85 | 662 |
| hCV904974 | rs439401 | | rmi | TC + CC | 101 | 1090 | 122 | 1025 |
| hCV904974 | rs439401 | | rmi | TT | 10 | 194 | 26 | 199 |
| hCV15954645 | rs2954029 | | rmi | AA | 36 | 376 | 31 | 344 |
| hCV15954645 | rs2954029 | | rmi | AT | 46 | 613 | 89 | 601 |
| hCV15954645 | rs2954029 | | rmi | TT | 28 | 296 | 28 | 278 |
| hCV29684678 | rs10486788 | | rmi | CC | 9 | 89 | 6 | 105 |
| hCV29684678 | rs10486788 | | rmi | CG | 40 | 526 | 67 | 481 |
| hCV29684678 | rs10486788 | | rmi | GG | 62 | 672 | 74 | 637 |
| hCV621313 | rs471364 | C9orf52 | rmi | CC | 2 | 16 | 1 | 24 |
| hCV621313 | rs471364 | C9orf52 | rmi | CT | 20 | 288 | 41 | 263 |
| hCV621313 | rs471364 | C9orf52 | rmi | TT | 89 | 984 | 106 | 936 |
| hDV70938014 | rs17321515 | | rmi | AA | 34 | 363 | 31 | 328 |
| hDV70938014 | rs17321515 | | rmi | AG | 47 | 620 | 88 | 612 |
| hDV70938014 | rs17321515 | | rmi | GG | 30 | 309 | 29 | 287 |
| hCV11446935 | rs2409722 | XKR6 | rmi | GG | 39 | 325 | 39 | 337 |
| hCV11446935 | rs2409722 | XKR6 | rmi | GT + TT | 72 | 960 | 109 | 888 |
| hCV10048483 | rs2145270 | | rmi | CC | 22 | 187 | 16 | 166 |
| hCV10048483 | rs2145270 | | rmi | CT + TT | 89 | 1103 | 132 | 1059 |

| SNP | P value | HR | HR95L | HR95U | P interaction | Allele1 | Allele1 Freq. | Allele2 | Allele2 Freq. |
|---|---|---|---|---|---|---|---|---|---|
| hCV16189421 | 0.9853 | 1 | 0.708 | 1.421 | 0.0830 | T | 0.24 | C | 0.76 |
| hCV16189421 | 0.0101 | 0.67 | 0.488 | 0.907 | 0.0830 | T | 0.24 | C | 0.76 |
| hCV25630686 | 0.0453 | 0.35 | 0.127 | 0.978 | 0.0993 | T | 0.03 | C | 0.97 |
| hCV25630686 | 0.0728 | 0.81 | 0.637 | 1.02 | 0.0993 | T | 0.03 | C | 0.97 |
| hCV25631989 | 0.0761 | 1.83 | 0.939 | 3.555 | 0.0080 | T | 0.08 | C | 0.92 |
| hCV25631989 | 0.0099 | 0.72 | 0.561 | 0.924 | 0.0080 | T | 0.08 | C | 0.92 |
| hCV25644901 | 0.0029 | 0.32 | 0.148 | 0.674 | 0.0093 | G | 0.05 | A | 0.95 |
| hCV25644901 | 0.2050 | 0.86 | 0.671 | 1.089 | 0.0093 | G | 0.05 | A | 0.95 |
| hCV25651076 | 0.5467 | 1.19 | 0.676 | 2.096 | 0.0926 | A | 0.09 | G | 0.91 |
| hCV25651076 | 0.0061 | 0.7 | 0.546 | 0.904 | 0.0926 | A | 0.09 | G | 0.91 |
| hCV25651174 | 0.7173 | 0.94 | 0.689 | 1.293 | 0.0684 | G | 0.30 | A | 0.70 |
| hCV25651174 | 0.0046 | 0.62 | 0.441 | 0.861 | 0.0684 | G | 0.30 | A | 0.70 |
| hCV25767417 | 0.0565 | 0.3 | 0.085 | 1.034 | 0.0897 | G | 0.02 | A | 0.98 |
| hCV25767417 | 0.0703 | 0.81 | 0.637 | 1.018 | 0.0897 | G | 0.02 | A | 0.98 |
| hCV25922320 | 0.4063 | 1.17 | 0.812 | 1.673 | 0.0033 | A | 0.21 | G | 0.79 |
| hCV25922320 | 0.0003 | 0.58 | 0.428 | 0.781 | 0.0033 | A | 0.21 | G | 0.79 |
| hCV25922440 | 0.0139 | 0.57 | 0.36 | 0.891 | 0.0728 | T | 0.16 | C | 0.84 |
| hCV25922440 | 0.5029 | 0.91 | 0.697 | 1.194 | 0.0728 | T | 0.16 | C | 0.84 |

TABLE 21-continued

CHD Risk Reduction by Pravastatin in CARE According to SNP Genotypes

| | | | | | | | | | |
|---|---|---|---|---|---|---|---|---|---|
| hCV25922816 | 0.0118 | 0.44 | 0.229 | 0.832 | 0.0487 | A | 0.07 | G | 0.93 |
| hCV25922816 | 0.2573 | 0.87 | 0.677 | 1.11 | 0.0487 | A | 0.07 | G | 0.93 |
| hCV25926178 | 0.0060 | 0.67 | 0.502 | 0.891 | 0.0710 | G | 0.38 | C | 0.62 |
| hCV25926178 | 0.8351 | 1.04 | 0.707 | 1.536 | 0.0710 | G | 0.38 | C | 0.62 |
| hCV25926771 | 0.0035 | 0.65 | 0.49 | 0.869 | 0.0316 | C | 0.31 | T | 0.69 |
| hCV25926771 | 0.6009 | 1.11 | 0.75 | 1.645 | 0.0316 | C | 0.31 | T | 0.69 |
| hCV25927605 | 0.1082 | 2.88 | 0.792 | 10.466 | 0.0216 | T | 0.03 | C | 0.97 |
| hCV25927605 | 0.0067 | 0.72 | 0.571 | 0.914 | 0.0216 | T | 0.03 | C | 0.97 |
| hCV25928135 | 0.0091 | 0.59 | 0.4 | 0.878 | 0.0741 | C | 0.21 | T | 0.79 |
| hCV25928135 | 0.5831 | 0.92 | 0.694 | 1.228 | 0.0741 | C | 0.21 | T | 0.79 |
| hCV25941408 | 0.0035 | 0.43 | 0.248 | 0.761 | 0.0191 | T | 0.10 | G | 0.90 |
| hCV25941408 | 0.3660 | 0.89 | 0.691 | 1.146 | 0.0191 | T | 0.10 | G | 0.90 |
| hCV25942539 | 0.0067 | 0.65 | 0.47 | 0.886 | 0.0496 | A | 0.34 | G | 0.66 |
| hCV25942539 | 0.8839 | 1.03 | 0.729 | 1.444 | 0.0496 | A | 0.34 | G | 0.66 |
| hCV26000635 | 0.8006 | 0.96 | 0.709 | 1.304 | 0.0322 | C | 0.31 | A | 0.69 |
| hCV26000635 | 0.0024 | 0.58 | 0.409 | 0.824 | 0.0322 | C | 0.31 | A | 0.69 |
| hCV2633049 | 0.8749 | 1.03 | 0.691 | 1.544 | 0.0812 | G | 0.20 | T | 0.81 |
| hCV2633049 | 0.0050 | 0.67 | 0.507 | 0.887 | 0.0812 | G | 0.20 | T | 0.81 |
| hCV2658421 | 0.0037 | 0.59 | 0.412 | 0.842 | 0.0496 | A | 0.23 | C | 0.77 |
| hCV2658421 | 0.6671 | 0.94 | 0.692 | 1.266 | 0.0496 | A | 0.23 | C | 0.77 |
| hCV2741051 | 0.9717 | 0.99 | 0.703 | 1.406 | 0.0576 | T | 0.28 | C | 0.72 |
| hCV2741051 | 0.0038 | 0.63 | 0.467 | 0.864 | 0.0576 | T | 0.28 | C | 0.72 |
| hCV2741083 | 0.2143 | 1.39 | 0.826 | 2.351 | 0.0119 | C | 0.13 | T | 0.87 |
| hCV2741083 | 0.0020 | 0.67 | 0.515 | 0.862 | 0.0119 | C | 0.13 | T | 0.87 |
| hCV2932115 | 0.7201 | 0.94 | 0.687 | 1.297 | 0.0755 | C | 0.27 | T | 0.73 |
| hCV2932115 | 0.0050 | 0.62 | 0.447 | 0.867 | 0.0755 | C | 0.27 | T | 0.73 |
| hCV2983035 | 0.0110 | 0.58 | 0.378 | 0.882 | 0.0944 | A | 0.15 | G | 0.85 |
| hCV2983035 | 0.3656 | 0.88 | 0.671 | 1.158 | 0.0944 | A | 0.15 | G | 0.85 |
| hCV3026189 | 0.4448 | 1.24 | 0.716 | 2.14 | 0.0557 | T | 0.10 | C | 0.90 |
| hCV3026189 | 0.0048 | 0.69 | 0.54 | 0.895 | 0.0557 | T | 0.10 | C | 0.90 |
| hCV3068176 | 0.3839 | 0.89 | 0.676 | 1.162 | 0.0609 | A | 0.46 | G | 0.54 |
| hCV3068176 | 0.0062 | 0.55 | 0.355 | 0.842 | 0.0609 | A | 0.46 | G | 0.54 |
| hCV3111721 | 0.0160 | 0.4 | 0.191 | 0.844 | 0.0645 | T | 0.06 | C | 0.94 |
| hCV3111721 | 0.1265 | 0.83 | 0.651 | 1.055 | 0.0645 | T | 0.06 | C | 0.94 |
| hCV529706 | 0.0036 | 0.6 | 0.426 | 0.846 | 0.0611 | C | 0.24 | G | 0.76 |
| hCV529706 | 0.6603 | 0.93 | 0.685 | 1.271 | 0.0611 | C | 0.24 | G | 0.76 |
| hCV529710 | 0.0052 | 0.62 | 0.44 | 0.866 | 0.0858 | C | 0.24 | G | 0.76 |
| hCV529710 | 0.6155 | 0.92 | 0.677 | 1.26 | 0.0858 | C | 0.24 | G | 0.76 |
| hCV5478 | 0.0953 | 2.65 | 0.843 | 8.319 | 0.0175 | T | 0.03 | C | 0.97 |
| hCV5478 | 0.0067 | 0.72 | 0.571 | 0.914 | 0.0175 | T | 0.03 | C | 0.97 |
| hCV549926 | 0.0042 | 0.54 | 0.35 | 0.822 | 0.0495 | C | 0.16 | T | 0.84 |
| hCV549926 | 0.3934 | 0.89 | 0.675 | 1.167 | 0.0495 | C | 0.16 | T | 0.84 |
| hCV594695 | 0.3548 | 1.42 | 0.675 | 2.997 | 0.0813 | A | 0.04 | T | 0.96 |
| hCV594695 | 0.0055 | 0.71 | 0.555 | 0.904 | 0.0813 | A | 0.04 | T | 0.96 |
| hCV598677 | 0.0035 | 0.57 | 0.391 | 0.831 | 0.0339 | T | 0.22 | G | 0.78 |
| hCV598677 | 0.7179 | 0.95 | 0.709 | 1.268 | 0.0339 | T | 0.22 | G | 0.78 |
| hCV7441704 | 0.0354 | 0.39 | 0.164 | 0.938 | 0.0966 | G | 0.05 | A | 0.95 |
| hCV7441704 | 0.0868 | 0.81 | 0.64 | 1.031 | 0.0966 | G | 0.05 | A | 0.95 |
| hCV7443062 | 0.5540 | 0.92 | 0.702 | 1.208 | 0.0186 | T | 0.45 | C | 0.55 |
| hCV7443062 | 0.0021 | 0.5 | 0.325 | 0.78 | 0.0186 | T | 0.45 | C | 0.55 |
| hCV7475492 | 0.5131 | 1.22 | 0.677 | 2.181 | 0.0988 | T | 0.07 | C | 0.93 |
| hCV7475492 | 0.0072 | 0.71 | 0.553 | 0.912 | 0.0988 | T | 0.07 | C | 0.93 |
| hCV7490135 | 0.0018 | 0.64 | 0.49 | 0.849 | 0.0207 | C | 0.47 | T | 0.53 |
| hCV7490135 | 0.4748 | 1.17 | 0.765 | 1.78 | 0.0207 | C | 0.47 | T | 0.53 |
| hCV7494810 | 0.0017 | 0.56 | 0.389 | 0.804 | 0.0241 | G | 0.25 | C | 0.75 |
| hCV7494810 | 0.7657 | 0.96 | 0.708 | 1.289 | 0.0241 | G | 0.25 | C | 0.75 |
| hCV7499212 | 0.0366 | 0.34 | 0.121 | 0.934 | 0.0831 | T | 0.02 | C | 0.98 |
| hCV7499212 | 0.0771 | 0.81 | 0.639 | 1.023 | 0.0831 | T | 0.02 | C | 0.98 |
| hCV7514879 | 0.0048 | 0.54 | 0.348 | 0.827 | 0.0538 | A | 0.17 | G | 0.83 |
| hCV7514879 | 0.4029 | 0.89 | 0.679 | 1.168 | 0.0538 | A | 0.17 | G | 0.83 |
| hCV7577801 | 0.6023 | 1.11 | 0.753 | 1.629 | 0.0200 | T | 0.22 | C | 0.78 |
| hCV7577801 | 0.0015 | 0.63 | 0.471 | 0.837 | 0.0200 | T | 0.22 | C | 0.78 |
| hCV7618856 | 0.0972 | 6.39 | 0.714 | 57.205 | 0.0287 | C | 0.01 | T | 0.99 |
| hCV7618856 | 0.0114 | 0.74 | 0.588 | 0.935 | 0.0287 | C | 0.01 | T | 0.99 |
| hCV783138 | 0.4753 | 1.21 | 0.713 | 2.069 | 0.0600 | A | 0.11 | G | 0.89 |
| hCV783138 | 0.0051 | 0.69 | 0.537 | 0.896 | 0.0600 | A | 0.11 | G | 0.89 |
| hCV783184 | 0.5952 | 1.15 | 0.688 | 1.918 | 0.0802 | T | 0.12 | G | 0.88 |
| hCV783184 | 0.0053 | 0.69 | 0.536 | 0.897 | 0.0802 | T | 0.12 | G | 0.88 |
| hCV7841642 | 0.0103 | 0.43 | 0.222 | 0.817 | 0.0473 | A | 0.07 | G | 0.93 |
| hCV7841642 | 0.1808 | 0.85 | 0.661 | 1.081 | 0.0473 | A | 0.07 | G | 0.93 |
| hCV7900503 | 0.7875 | 0.95 | 0.679 | 1.341 | 0.0908 | T | 0.28 | C | 0.72 |
| hCV7900503 | 0.0051 | 0.64 | 0.471 | 0.875 | 0.0908 | T | 0.28 | C | 0.72 |
| hCV795441 | 0.8725 | 0.97 | 0.715 | 1.329 | 0.0296 | G | 0.32 | C | 0.68 |
| hCV795441 | 0.0022 | 0.58 | 0.414 | 0.825 | 0.0296 | G | 0.32 | C | 0.68 |
| hCV795442 | 0.9472 | 0.99 | 0.724 | 1.353 | 0.0218 | G | 0.32 | A | 0.68 |
| hCV795442 | 0.0016 | 0.58 | 0.408 | 0.812 | 0.0218 | G | 0.32 | A | 0.68 |
| hCV8705506 | 0.0032 | 0.62 | 0.456 | 0.854 | 0.0480 | C | 0.34 | G | 0.66 |
| hCV8705506 | 0.9467 | 0.99 | 0.706 | 1.384 | 0.0480 | C | 0.34 | G | 0.66 |

TABLE 21-continued

CHD Risk Reduction by Pravastatin in CARE According to SNP Genotypes

| | | | | | | | | | |
|---|---|---|---|---|---|---|---|---|---|
| hCV8708474 | 0.5341 | 1.19 | 0.69 | 2.046 | 0.0851 | T | 0.09 | C | 0.91 |
| hCV8708474 | 0.0062 | 0.7 | 0.545 | 0.905 | 0.0851 | T | 0.09 | C | 0.91 |
| hCV8718197 | 0.6535 | 0.94 | 0.71 | 1.24 | 0.0102 | G | 0.44 | A | 0.56 |
| hCV8718197 | 0.0008 | 0.49 | 0.322 | 0.744 | 0.0102 | G | 0.44 | A | 0.56 |
| hCV8726337 | 0.5198 | 0.92 | 0.7 | 1.198 | 0.0274 | G | 0.44 | A | 0.56 |
| hCV8726337 | 0.0031 | 0.51 | 0.329 | 0.798 | 0.0274 | G | 0.44 | A | 0.56 |
| hCV8848630 | 0.0054 | 0.66 | 0.487 | 0.883 | 0.0756 | T | 0.38 | G | 0.62 |
| hCV8848630 | 0.9870 | 1 | 0.698 | 1.441 | 0.0756 | T | 0.38 | G | 0.62 |
| hCV8851085 | 0.9498 | 0.99 | 0.687 | 1.422 | 0.0838 | A | 0.22 | G | 0.78 |
| hCV8851085 | 0.0049 | 0.65 | 0.485 | 0.878 | 0.0838 | A | 0.22 | G | 0.78 |
| hCV8895373 | 0.5323 | 1.14 | 0.762 | 1.694 | 0.0203 | A | 0.18 | G | 0.82 |
| hCV8895373 | 0.0018 | 0.64 | 0.481 | 0.847 | 0.0203 | A | 0.18 | G | 0.82 |
| hCV8901525 | 0.9319 | 0.99 | 0.733 | 1.329 | 0.0204 | A | 0.37 | G | 0.63 |
| hCV8901525 | 0.0025 | 0.57 | 0.39 | 0.818 | 0.0204 | A | 0.37 | G | 0.63 |
| hCV8921288 | 0.0003 | 0.48 | 0.319 | 0.71 | 0.0008 | C | 0.20 | A | 0.80 |
| hCV8921288 | 0.5588 | 1.09 | 0.815 | 1.459 | 0.0008 | C | 0.20 | A | 0.80 |
| hCV904973 | 0.2198 | 1.59 | 0.757 | 3.348 | 0.0416 | T | 0.06 | C | 0.94 |
| hCV904973 | 0.0059 | 0.71 | 0.559 | 0.907 | 0.0416 | T | 0.06 | C | 0.94 |
| hCV9077561 | 0.0027 | 0.67 | 0.515 | 0.87 | 0.0357 | G | 0.50 | A | 0.50 |
| hCV9077561 | 0.4605 | 1.2 | 0.743 | 1.926 | 0.0357 | G | 0.50 | A | 0.50 |
| hCV9494470 | 0.0102 | 0.57 | 0.368 | 0.874 | 0.0957 | T | 0.17 | G | 0.83 |
| hCV9494470 | 0.3255 | 0.87 | 0.666 | 1.144 | 0.0957 | T | 0.17 | G | 0.83 |
| hCV9506149 | 0.8631 | 0.97 | 0.695 | 1.357 | 0.0654 | T | 0.28 | A | 0.72 |
| hCV9506149 | 0.0042 | 0.63 | 0.46 | 0.865 | 0.0654 | T | 0.28 | A | 0.72 |
| hCV9604851 | 0.1884 | 1.59 | 0.797 | 3.171 | 0.0273 | A | 0.05 | G | 0.95 |
| hCV9604851 | 0.0046 | 0.7 | 0.552 | 0.898 | 0.0273 | A | 0.05 | G | 0.95 |
| hCV2553030 | 0.1178 | 0.83 | 0.657 | 1.048 | 0.0059 | T | 0.25 | C | 0.75 |
| hCV2553030 | 0.0062 | 0.17 | 0.047 | 0.603 | 0.0059 | T | 0.25 | C | 0.75 |
| hCV25637309 | 0.0013 | 0.67 | 0.522 | 0.855 | 0.0031 | A | 0.39 | T | 0.61 |
| hCV25637309 | 0.0572 | 1.87 | 0.981 | 3.566 | 0.0031 | A | 0.39 | T | 0.61 |
| hCV25640504 | 0.1795 | 0.84 | 0.653 | 1.083 | 0.0390 | T | 0.28 | C | 0.72 |
| hCV25640504 | 0.0084 | 0.4 | 0.205 | 0.792 | 0.0390 | T | 0.28 | C | 0.72 |
| hCV2769554 | 0.0021 | 0.67 | 0.52 | 0.865 | 0.0118 | G | 0.46 | A | 0.54 |
| hCV2769554 | 0.1841 | 1.45 | 0.837 | 2.518 | 0.0118 | G | 0.46 | A | 0.54 |
| hCV2822674 | 0.1375 | 0.83 | 0.655 | 1.06 | 0.0448 | A | 0.32 | G | 0.68 |
| hCV2822674 | 0.0120 | 0.38 | 0.179 | 0.808 | 0.0448 | A | 0.32 | G | 0.68 |
| hCV2992252 | 0.1532 | 0.84 | 0.658 | 1.068 | 0.0173 | C | 0.40 | T | 0.60 |
| hCV2992252 | 0.0052 | 0.32 | 0.145 | 0.713 | 0.0173 | C | 0.40 | T | 0.60 |
| hCV3187716 | 0.1486 | 0.84 | 0.661 | 1.065 | 0.0111 | C | 0.30 | A | 0.70 |
| hCV3187716 | 0.0061 | 0.26 | 0.097 | 0.679 | 0.0111 | C | 0.30 | A | 0.70 |
| hCV3215409 | 0.2979 | 0.88 | 0.682 | 1.124 | 0.0133 | G | 0.42 | A | 0.58 |
| hCV3215409 | 0.0026 | 0.4 | 0.218 | 0.723 | 0.0133 | G | 0.42 | A | 0.58 |
| hCV3219460 | 0.1316 | 0.83 | 0.654 | 1.057 | 0.0495 | T | 0.35 | G | 0.65 |
| hCV3219460 | 0.0157 | 0.38 | 0.175 | 0.834 | 0.0495 | T | 0.35 | G | 0.65 |
| hCV370782 | 0.0065 | 0.71 | 0.558 | 0.91 | 0.0938 | C | 0.38 | T | 0.62 |
| hCV370782 | 0.4473 | 1.3 | 0.664 | 2.532 | 0.0938 | C | 0.38 | T | 0.62 |
| hCV7514870 | 0.1397 | 0.83 | 0.655 | 1.061 | 0.0624 | A | 0.33 | C | 0.67 |
| hCV7514870 | 0.0110 | 0.4 | 0.194 | 0.809 | 0.0624 | A | 0.33 | C | 0.67 |
| hCV818008 | 0.0099 | 0.74 | 0.584 | 0.929 | 0.0236 | C | 0.15 | T | 0.85 |
| hCV818008 | 0.1271 | 5.11 | 0.628 | 41.557 | 0.0236 | C | 0.15 | T | 0.85 |
| hCV8708473 | 0.1014 | 0.82 | 0.644 | 1.04 | 0.0991 | A | 0.32 | G | 0.68 |
| hCV8708473 | 0.0331 | 0.43 | 0.193 | 0.934 | 0.0991 | A | 0.32 | G | 0.68 |
| hCV8709053 | 0.3282 | 0.88 | 0.674 | 1.141 | 0.0636 | G | 0.50 | A | 0.50 |
| hCV8709053 | 0.0077 | 0.53 | 0.331 | 0.845 | 0.0636 | G | 0.50 | A | 0.50 |
| hCV8737990 | 0.0035 | 0.7 | 0.551 | 0.89 | 0.0157 | C | 0.28 | T | 0.72 |
| hCV8737990 | 0.1156 | 1.99 | 0.844 | 4.699 | 0.0157 | C | 0.28 | T | 0.72 |
| hCV8784787 | 0.0088 | 0.73 | 0.581 | 0.925 | 0.0443 | A | 0.23 | C | 0.77 |
| hCV8784787 | 0.1452 | 3.29 | 0.663 | 16.304 | 0.0443 | A | 0.23 | C | 0.77 |
| hCV8804621 | 0.0120 | 0.74 | 0.586 | 0.936 | 0.0805 | A | 0.25 | G | 0.75 |
| hCV8804621 | 0.2298 | 2.09 | 0.628 | 6.934 | 0.0805 | A | 0.25 | G | 0.75 |
| hCV8851047 | 0.0224 | 0.76 | 0.602 | 0.962 | 0.0104 | C | 0.17 | T | 0.83 |
| hCV8851047 | 0.0779 | 6.59 | 0.81 | 53.622 | 0.0104 | C | 0.17 | T | 0.83 |
| hCV8851065 | 0.0072 | 0.72 | 0.57 | 0.916 | 0.0322 | G | 0.28 | C | 0.72 |
| hCV8851065 | 0.1152 | 2.1 | 0.835 | 5.264 | 0.0322 | G | 0.28 | C | 0.72 |
| hCV8851095 | 0.0229 | 0.76 | 0.603 | 0.963 | 0.0840 | T | 0.27 | C | 0.73 |
| hCV8851095 | 0.1712 | 2.37 | 0.688 | 8.198 | 0.0840 | T | 0.27 | C | 0.73 |
| hCV9055799 | 0.1628 | 0.84 | 0.658 | 1.073 | 0.0749 | C | 0.40 | G | 0.60 |
| hCV9055799 | 0.0153 | 0.45 | 0.233 | 0.857 | 0.0749 | C | 0.40 | G | 0.60 |
| hCV9596963 | 0.0027 | 0.68 | 0.534 | 0.877 | 0.0181 | G | 0.32 | A | 0.68 |
| hCV9596963 | 0.1985 | 1.53 | 0.8 | 2.934 | 0.0181 | G | 0.32 | A | 0.68 |
| hCV997884 | 0.0079 | 0.73 | 0.578 | 0.921 | 0.0466 | A | 0.20 | G | 0.80 |
| hCV997884 | 0.1428 | 3.41 | 0.661 | 17.577 | 0.0466 | A | 0.20 | G | 0.80 |
| hCV2983036 | 0.3494 | 2.25 | 0.412 | 12.278 | 0.0793 | C | 0.15 | G | 0.85 |
| hCV2983036 | 0.0043 | 0.53 | 0.338 | 0.818 | 0.0793 | C | 0.15 | G | 0.85 |
| hCV2983036 | 0.2806 | 0.86 | 0.656 | 1.13 | 0.0793 | C | 0.15 | G | 0.85 |
| hCV3135085 | 0.0690 | 0.5 | 0.234 | 1.056 | 0.0932 | G | 0.33 | T | 0.67 |
| hCV3135085 | 0.9477 | 1.01 | 0.712 | 1.437 | 0.0932 | G | 0.33 | T | 0.67 |
| hCV3135085 | 0.0116 | 0.65 | 0.462 | 0.908 | 0.0932 | G | 0.33 | T | 0.67 |

TABLE 21-continued

CHD Risk Reduction by Pravastatin in CARE According to SNP Genotypes

| | | | | | | | | | |
|---|---|---|---|---|---|---|---|---|---|
| hCV3275199 | 0.5551 | 1.64 | 0.318 | 8.446 | 0.0775 | A | 0.13 | G | 0.87 |
| hCV3275199 | 0.0060 | 0.45 | 0.255 | 0.796 | 0.0775 | A | 0.13 | G | 0.87 |
| hCV3275199 | 0.2088 | 0.85 | 0.658 | 1.096 | 0.0775 | A | 0.13 | G | 0.87 |
| hCV342590 | 0.6256 | 1.2 | 0.572 | 2.529 | 0.0995 | C | 0.31 | T | 0.69 |
| hCV342590 | 0.0034 | 0.57 | 0.394 | 0.832 | 0.0995 | C | 0.31 | T | 0.69 |
| hCV342590 | 0.4490 | 0.88 | 0.643 | 1.216 | 0.0995 | C | 0.31 | T | 0.69 |
| hCV435368 | 0.6056 | 0.89 | 0.582 | 1.371 | 0.0948 | T | 0.47 | C | 0.53 |
| hCV435368 | 0.0028 | 0.6 | 0.428 | 0.838 | 0.0948 | T | 0.47 | C | 0.53 |
| hCV435368 | 0.7363 | 1.08 | 0.68 | 1.726 | 0.0948 | T | 0.47 | C | 0.53 |
| hCV11170747 | 0.2728 | 0.87 | 0.673 | 1.118 | 0.0356 | A | 0.11 | G | 0.89 |
| hCV11170747 | 0.0036 | 0.44 | 0.256 | 0.767 | 0.0356 | A | 0.11 | G | 0.89 |
| hCV11181829 | 0.0112 | 0.74 | 0.584 | 0.933 | 0.0735 | C | 0.01 | T | 0.99 |
| hCV11181829 | 0.2129 | 2.14 | 0.646 | 7.125 | 0.0735 | C | 0.01 | T | 0.99 |
| hCV11225994 | 0.0026 | 0.66 | 0.508 | 0.866 | 0.0671 | A | 0.13 | G | 0.87 |
| hCV11225994 | 0.7086 | 1.09 | 0.686 | 1.741 | 0.0671 | A | 0.13 | G | 0.87 |
| hCV11438723 | 0.9973 | 0 | 0 | | 0.0772 | T | 0.10 | C | 0.90 |
| hCV11438723 | 0.0368 | 0.78 | 0.623 | 0.985 | 0.0772 | T | 0.10 | C | 0.90 |
| hCV11461296 | 0.0389 | 0.78 | 0.616 | 0.987 | 0.0111 | C | 0.02 | G | 0.98 |
| hCV11461296 | 0.0255 | 0.09 | 0.012 | 0.749 | 0.0111 | C | 0.02 | G | 0.98 |
| hCV11628130 | 0.0116 | 0.48 | 0.269 | 0.848 | 0.0640 | T | 0.42 | A | 0.58 |
| hCV11628130 | 0.2005 | 0.85 | 0.659 | 1.091 | 0.0640 | T | 0.42 | A | 0.58 |
| hCV11642651 | 0.0467 | 0.27 | 0.074 | 0.981 | 0.0718 | C | 0.19 | T | 0.81 |
| hCV11642651 | 0.0651 | 0.8 | 0.636 | 1.014 | 0.0718 | C | 0.19 | T | 0.81 |
| hCV11689916 | 0.0159 | 0.59 | 0.39 | 0.907 | 0.0899 | A | 0.48 | T | 0.52 |
| hCV11689916 | 0.5024 | 0.91 | 0.689 | 1.201 | 0.0899 | A | 0.48 | T | 0.52 |
| hCV11697322 | 0.0037 | 0.62 | 0.445 | 0.854 | 0.0540 | A | 0.29 | G | 0.71 |
| hCV11697322 | 0.8558 | 0.97 | 0.702 | 1.342 | 0.0540 | A | 0.29 | G | 0.71 |
| hCV11764545 | 0.0708 | 0.23 | 0.049 | 1.131 | 0.0921 | T | 0.18 | G | 0.82 |
| hCV11764545 | 0.0573 | 0.8 | 0.634 | 1.007 | 0.0921 | T | 0.18 | G | 0.82 |
| hCV11955747 | 0.3731 | 0.89 | 0.679 | 1.156 | 0.0491 | A | 0.16 | C | 0.84 |
| hCV11955747 | 0.0058 | 0.53 | 0.336 | 0.832 | 0.0491 | A | 0.16 | C | 0.84 |
| hCV11972326 | 0.2560 | 1.67 | 0.69 | 4.03 | 0.0738 | G | 0.24 | C | 0.76 |
| hCV11972326 | 0.0103 | 0.73 | 0.577 | 0.929 | 0.0738 | G | 0.24 | C | 0.76 |
| hCV12020339 | 0.0043 | 0.69 | 0.538 | 0.891 | 0.0686 | T | 0.08 | G | 0.92 |
| hCV12020339 | 0.4707 | 1.24 | 0.696 | 2.193 | 0.0686 | T | 0.08 | G | 0.92 |
| hCV12108469 | 0.0353 | 0.2 | 0.043 | 0.893 | 0.0439 | A | 0.21 | G | 0.79 |
| hCV12108469 | 0.0427 | 0.79 | 0.621 | 0.992 | 0.0439 | A | 0.21 | G | 0.79 |
| hCV1243283 | 0.0037 | 0.33 | 0.158 | 0.7 | 0.0173 | A | 0.33 | G | 0.67 |
| hCV1243283 | 0.1788 | 0.85 | 0.666 | 1.079 | 0.0173 | A | 0.33 | G | 0.67 |
| hCV1253630 | 0.0030 | 0.55 | 0.373 | 0.818 | 0.0332 | A | 0.41 | G | 0.59 |
| hCV1253630 | 0.6277 | 0.93 | 0.7 | 1.24 | 0.0332 | A | 0.41 | G | 0.59 |
| hCV1345898 | 0.0134 | 0.51 | 0.299 | 0.869 | 0.0835 | C | 0.48 | T | 0.52 |
| hCV1345898 | 0.2025 | 0.85 | 0.657 | 1.093 | 0.0835 | C | 0.48 | T | 0.52 |
| hCV1361979 | 0.0037 | 0.54 | 0.36 | 0.821 | 0.0443 | A | 0.43 | G | 0.57 |
| hCV1361979 | 0.4633 | 0.9 | 0.684 | 1.189 | 0.0443 | A | 0.43 | G | 0.57 |
| hCV1375141 | 0.4852 | 1.43 | 0.521 | 3.947 | 0.0936 | C | 0.21 | T | 0.79 |
| hCV1375141 | 0.0053 | 0.55 | 0.357 | 0.835 | 0.0936 | C | 0.21 | T | 0.79 |
| hCV1375141 | 0.3071 | 0.86 | 0.648 | 1.146 | 0.0936 | C | 0.21 | T | 0.79 |
| hCV1552894 | 0.0028 | 0.42 | 0.234 | 0.739 | 0.0162 | G | 0.42 | A | 0.58 |
| hCV1552894 | 0.3177 | 0.88 | 0.681 | 1.133 | 0.0162 | G | 0.42 | A | 0.58 |
| hCV1552900 | 0.0030 | 0.42 | 0.236 | 0.744 | 0.0159 | A | 0.42 | G | 0.58 |
| hCV1552900 | 0.3456 | 0.89 | 0.687 | 1.141 | 0.0159 | A | 0.42 | G | 0.58 |
| hCV15746640 | 0.0032 | 0.69 | 0.539 | 0.883 | 0.0177 | G | 0.08 | A | 0.92 |
| hCV15746640 | 0.1717 | 1.57 | 0.823 | 2.99 | 0.0177 | G | 0.08 | A | 0.92 |
| hCV15758290 | 0.0030 | 0.6 | 0.434 | 0.843 | 0.0441 | G | 0.30 | A | 0.70 |
| hCV15758290 | 0.8294 | 0.97 | 0.703 | 1.326 | 0.0441 | G | 0.30 | A | 0.70 |
| hCV15760070 | 0.0713 | 6.88 | 0.846 | 56.019 | 0.0073 | T | 0.17 | A | 0.83 |
| hCV15760070 | 0.0090 | 0.73 | 0.582 | 0.926 | 0.0073 | T | 0.17 | A | 0.83 |
| hCV15851335 | 0.0073 | 0.71 | 0.558 | 0.913 | 0.0891 | T | 0.07 | C | 0.93 |
| hCV15851335 | 0.4412 | 1.29 | 0.678 | 2.437 | 0.0891 | T | 0.07 | C | 0.93 |
| hCV15851779 | 0.9977 | 0 | 0 | | 0.0624 | A | 0.06 | G | 0.94 |
| hCV15851779 | 0.3772 | 1.36 | 0.687 | 2.693 | 0.0624 | A | 0.06 | G | 0.94 |
| hCV15851779 | 0.0103 | 0.73 | 0.569 | 0.927 | 0.0624 | A | 0.06 | G | 0.94 |
| hCV15876011 | 0.3001 | 1.32 | 0.783 | 2.212 | 0.0268 | G | 0.45 | T | 0.55 |
| hCV15876011 | 0.0048 | 0.69 | 0.529 | 0.892 | 0.0268 | G | 0.45 | T | 0.55 |
| hCV15954277 | 0.0411 | 3.7 | 1.054 | 12.989 | 0.0042 | A | 0.26 | G | 0.74 |
| hCV15954277 | 0.0054 | 0.72 | 0.565 | 0.906 | 0.0042 | A | 0.26 | G | 0.74 |
| hCV15955388 | 0.0594 | 0.8 | 0.635 | 1.009 | 0.0435 | T | 0.02 | C | 0.98 |
| hCV15955388 | 0.0629 | 0.14 | 0.017 | 1.112 | 0.0435 | T | 0.02 | C | 0.98 |
| hCV15963535 | 0.1293 | 0.83 | 0.652 | 1.056 | 0.0412 | G | 0.05 | C | 0.95 |
| hCV15963535 | 0.0128 | 0.36 | 0.161 | 0.805 | 0.0412 | G | 0.05 | C | 0.95 |
| hCV1600754 | 0.0099 | 0.56 | 0.366 | 0.872 | 0.0869 | T | 0.46 | C | 0.54 |
| hCV1600754 | 0.3365 | 0.88 | 0.669 | 1.147 | 0.0869 | T | 0.46 | C | 0.54 |
| hCV1603697 | 0.1196 | 0.83 | 0.648 | 1.051 | 0.0985 | T | 0.06 | C | 0.94 |
| hCV1603697 | 0.0253 | 0.44 | 0.215 | 0.904 | 0.0985 | T | 0.06 | C | 0.94 |
| hCV16044337 | 0.0012 | 0.25 | 0.11 | 0.582 | 0.0028 | A | 0.31 | G | 0.69 |
| hCV16044337 | 0.2664 | 0.87 | 0.685 | 1.11 | 0.0028 | A | 0.31 | G | 0.69 |
| hCV16047108 | 0.0025 | 0.68 | 0.527 | 0.872 | 0.0174 | G | 0.06 | A | 0.94 |

TABLE 21-continued

CHD Risk Reduction by Pravastatin in CARE According to SNP Genotypes

| | | | | | | | | | |
|---|---|---|---|---|---|---|---|---|---|
| hCV16047108 | 0.2238 | 1.43 | 0.804 | 2.537 | 0.0174 | G | 0.06 | A | 0.94 |
| hCV16172339 | 0.1176 | 0.82 | 0.646 | 1.05 | 0.0974 | T | 0.06 | A | 0.94 |
| hCV16172339 | 0.0251 | 0.44 | 0.214 | 0.903 | 0.0974 | T | 0.06 | A | 0.94 |
| hCV16173091 | 0.1086 | 1.88 | 0.869 | 4.079 | 0.0148 | C | 0.32 | T | 0.68 |
| hCV16173091 | 0.0041 | 0.7 | 0.552 | 0.894 | 0.0148 | C | 0.32 | T | 0.68 |
| hCV16179493 | 0.0015 | 0.58 | 0.413 | 0.811 | 0.0241 | T | 0.31 | C | 0.69 |
| hCV16179493 | 0.9145 | 0.98 | 0.715 | 1.351 | 0.0241 | T | 0.31 | C | 0.69 |
| hCV16179628 | 0.0562 | 0.12 | 0.013 | 1.058 | 0.0472 | A | 0.20 | G | 0.80 |
| hCV16179628 | 0.0668 | 0.81 | 0.641 | 1.015 | 0.0472 | A | 0.20 | G | 0.80 |
| hCV16182835 | 0.8609 | 1.03 | 0.733 | 1.451 | 0.0411 | G | 0.34 | A | 0.66 |
| hCV16182835 | 0.0053 | 0.64 | 0.463 | 0.874 | 0.0411 | G | 0.34 | A | 0.66 |
| hCV16192174 | 0.0052 | 0.69 | 0.53 | 0.895 | 0.0847 | A | 0.10 | G | 0.90 |
| hCV16192174 | 0.6835 | 1.1 | 0.685 | 1.78 | 0.0847 | A | 0.10 | G | 0.90 |
| hCV1647371 | 0.0026 | 0.6 | 0.429 | 0.835 | 0.0251 | T | 0.33 | C | 0.67 |
| hCV1647371 | 0.9194 | 1.02 | 0.737 | 1.403 | 0.0251 | T | 0.33 | C | 0.67 |
| hCV1741111 | 0.2976 | 1.68 | 0.632 | 4.486 | 0.0931 | T | 0.30 | C | 0.70 |
| hCV1741111 | 0.0109 | 0.74 | 0.581 | 0.932 | 0.0931 | T | 0.30 | C | 0.70 |
| hCV1770462 | 0.0070 | 0.72 | 0.562 | 0.913 | 0.0818 | A | 0.03 | G | 0.97 |
| hCV1770462 | 0.3614 | 1.41 | 0.677 | 2.918 | 0.0818 | A | 0.03 | G | 0.97 |
| hCV1843175 | 0.9494 | 0.99 | 0.687 | 1.422 | 0.0787 | A | 0.36 | C | 0.64 |
| hCV1843175 | 0.0040 | 0.65 | 0.482 | 0.87 | 0.0787 | A | 0.36 | C | 0.64 |
| hCV2038 | 0.0018 | 0.55 | 0.382 | 0.803 | 0.0216 | A | 0.34 | G | 0.66 |
| hCV2038 | 0.7717 | 0.96 | 0.714 | 1.284 | 0.0216 | A | 0.34 | G | 0.66 |
| hCV2143205 | 0.2301 | 1.65 | 0.729 | 3.732 | 0.0524 | A | 0.32 | G | 0.68 |
| hCV2143205 | 0.0072 | 0.72 | 0.567 | 0.915 | 0.0524 | A | 0.32 | G | 0.68 |
| hCV22271999 | 0.0060 | 0.69 | 0.532 | 0.9 | 0.0944 | T | 0.10 | C | 0.90 |
| hCV22271999 | 0.7100 | 1.09 | 0.679 | 1.764 | 0.0944 | T | 0.10 | C | 0.90 |
| hCV22274761 | 0.0831 | 0.81 | 0.64 | 1.028 | 0.0849 | A | 0.04 | G | 0.96 |
| hCV22274761 | 0.0333 | 0.36 | 0.141 | 0.923 | 0.0849 | A | 0.04 | G | 0.96 |
| hCV22275550 | 0.2235 | 4.08 | 0.424 | 39.314 | 0.0946 | C | 0.12 | T | 0.88 |
| hCV22275550 | 0.0139 | 0.75 | 0.594 | 0.943 | 0.0946 | C | 0.12 | T | 0.88 |
| hCV2230606 | 0.0109 | 0.74 | 0.584 | 0.932 | 0.0281 | G | 0.02 | A | 0.98 |
| hCV2230606 | 0.1073 | 2.93 | 0.792 | 10.814 | 0.0281 | G | 0.02 | A | 0.98 |
| hCV2276802 | 0.0088 | 0.56 | 0.364 | 0.865 | 0.0820 | C | 0.37 | A | 0.63 |
| hCV2276802 | 0.3623 | 0.88 | 0.673 | 1.156 | 0.0820 | C | 0.37 | A | 0.63 |
| hCV2310409 | 0.0061 | 0.66 | 0.494 | 0.889 | 0.1000 | A | 0.20 | T | 0.80 |
| hCV2310409 | 0.9347 | 0.98 | 0.68 | 1.426 | 0.1000 | A | 0.20 | T | 0.80 |
| hCV2485037 | 0.4154 | 1.25 | 0.73 | 2.146 | 0.0581 | A | 0.43 | G | 0.57 |
| hCV2485037 | 0.0082 | 0.71 | 0.547 | 0.914 | 0.0581 | A | 0.43 | G | 0.57 |
| hCV2503034 | 0.9978 | 0 | 0 | | 0.0411 | A | 0.11 | C | 0.89 |
| hCV2503034 | 0.3764 | 0.81 | 0.504 | 1.296 | 0.0411 | A | 0.11 | C | 0.89 |
| hCV2503034 | 0.0498 | 0.77 | 0.589 | 1 | 0.0411 | A | 0.11 | C | 0.89 |
| hCV2531086 | 0.1378 | 3.29 | 0.682 | 15.892 | 0.0460 | A | 0.21 | G | 0.79 |
| hCV2531086 | 0.0081 | 0.73 | 0.577 | 0.921 | 0.0460 | A | 0.21 | G | 0.79 |
| hCV2536595 | 0.1617 | 1.38 | 0.88 | 2.154 | 0.0027 | A | 0.47 | G | 0.63 |
| hCV2536595 | 0.0005 | 0.62 | 0.475 | 0.814 | 0.0027 | A | 0.47 | G | 0.53 |
| hCV25472345 | 0.0036 | 0.31 | 0.143 | 0.683 | 0.0075 | T | 0.34 | C | 0.66 |
| hCV25472345 | 0.3416 | 0.89 | 0.694 | 1.135 | 0.0075 | T | 0.34 | C | 0.66 |
| hCV25472673 | 0.4153 | 1.17 | 0.799 | 1.72 | 0.0080 | C | 0.39 | T | 0.61 |
| hCV25472673 | 0.0010 | 0.61 | 0.459 | 0.822 | 0.0080 | C | 0.39 | T | 0.61 |
| hCV25473098 | 0.1440 | 1.75 | 0.826 | 3.704 | 0.0227 | G | 0.31 | A | 0.69 |
| hCV25473098 | 0.0055 | 0.71 | 0.557 | 0.904 | 0.0227 | G | 0.31 | A | 0.69 |
| hCV25474101 | 0.0951 | 3.81 | 0.792 | 18.358 | 0.0195 | C | 0.15 | T | 0.85 |
| hCV25474101 | 0.0094 | 0.73 | 0.582 | 0.927 | 0.0195 | C | 0.15 | T | 0.85 |
| hCV25591528 | 0.2637 | 0.87 | 0.673 | 1.115 | 0.0417 | A | 0.12 | G | 0.88 |
| hCV25591528 | 0.0065 | 0.46 | 0.267 | 0.807 | 0.0417 | A | 0.12 | G | 0.88 |
| hCV25596880 | 0.9977 | 1E+08 | 0 | | 0.0713 | C | 0.06 | G | 0.94 |
| hCV25596880 | 0.9890 | 0.99 | 0.447 | 2.214 | 0.0713 | C | 0.06 | G | 0.94 |
| hCV25596880 | 0.0107 | 0.73 | 0.575 | 0.93 | 0.0713 | C | 0.06 | G | 0.94 |
| hCV25598594 | 0.1016 | 0.82 | 0.653 | 1.039 | 0.0028 | A | 0.02 | G | 0.98 |
| hCV25598594 | 0.0150 | 0.08 | 0.01 | 0.61 | 0.0028 | A | 0.02 | G | 0.98 |
| hCV25603879 | 0.0082 | 0.73 | 0.575 | 0.921 | 0.0527 | T | 0.03 | C | 0.97 |
| hCV25603879 | 0.2080 | 1.97 | 0.685 | 5.68 | 0.0527 | T | 0.03 | C | 0.97 |
| hCV25605897 | 0.1708 | 0.85 | 0.666 | 1.075 | 0.0166 | G | 0.06 | T | 0.94 |
| hCV25605897 | 0.0065 | 0.3 | 0.128 | 0.716 | 0.0166 | G | 0.06 | T | 0.94 |
| hCV25607193 | 0.0129 | 0.75 | 0.591 | 0.94 | 0.0477 | C | 0.01 | T | 0.99 |
| hCV25607193 | 0.1685 | 4.42 | 0.533 | 36.753 | 0.0477 | C | 0.01 | T | 0.99 |
| hCV25608818 | 0.0110 | 0.74 | 0.586 | 0.933 | 0.0206 | A | 0.01 | G | 0.99 |
| hCV25608818 | 0.0832 | 4.01 | 0.833 | 19.312 | 0.0206 | A | 0.01 | G | 0.99 |
| hCV25610470 | 0.0946 | 0.82 | 0.646 | 1.035 | 0.0431 | A | 0.04 | G | 0.96 |
| hCV25610470 | 0.0235 | 0.27 | 0.089 | 0.84 | 0.0431 | A | 0.04 | G | 0.96 |
| hCV25610774 | 0.2456 | 2.64 | 0.512 | 13.644 | 0.0989 | T | 0.23 | C | 0.77 |
| hCV25610774 | 0.0116 | 0.74 | 0.588 | 0.935 | 0.0989 | T | 0.23 | C | 0.77 |
| hCV25610819 | 0.2297 | 2.73 | 0.53 | 14.102 | 0.0925 | T | 0.23 | A | 0.77 |
| hCV25610819 | 0.0122 | 0.74 | 0.59 | 0.937 | 0.0925 | T | 0.23 | A | 0.77 |
| hCV25614016 | 0.0010 | 0.63 | 0.482 | 0.83 | 0.0072 | G | 0.16 | A | 0.84 |
| hCV25614016 | 0.2727 | 1.28 | 0.824 | 1.985 | 0.0072 | G | 0.16 | A | 0.84 |
| hCV25617571 | 0.2572 | 0.87 | 0.675 | 1.111 | 0.0208 | T | 0.08 | C | 0.92 |

TABLE 21-continued

CHD Risk Reduction by Pravastatin in CARE According to SNP Genotypes

| | | | | | | | | | |
|---|---|---|---|---|---|---|---|---|---|
| hCV25617571 | 0.0037 | 0.41 | 0.227 | 0.751 | 0.0208 | T | 0.08 | C | 0.92 |
| hCV25623265 | 0.0008 | 0.35 | 0.193 | 0.65 | 0.0039 | G | 0.48 | A | 0.52 |
| hCV25623265 | 0.3626 | 0.89 | 0.692 | 1.144 | 0.0039 | G | 0.48 | A | 0.52 |
| hCV25629396 | 0.0064 | 0.72 | 0.573 | 0.913 | 0.0011 | C | 0.01 | G | 0.99 |
| hCV25629396 | 0.0266 | 10.7 | 1.317 | 87.094 | 0.0011 | C | 0.01 | G | 0.99 |
| hCV25629476 | 0.0071 | 0.71 | 0.558 | 0.912 | 0.0602 | A | 0.05 | G | 0.95 |
| hCV25629476 | 0.3104 | 1.41 | 0.724 | 2.765 | 0.0602 | A | 0.05 | G | 0.95 |
| hCV25629492 | 0.6944 | 0.94 | 0.669 | 1.307 | 0.0916 | G | 0.36 | A | 0.64 |
| hCV25629492 | 0.0043 | 0.63 | 0.458 | 0.865 | 0.0916 | G | 0.36 | A | 0.64 |
| hCV25629888 | 0.1786 | 2.53 | 0.654 | 9.788 | 0.0742 | G | 0.17 | C | 0.83 |
| hCV25629888 | 0.0120 | 0.74 | 0.587 | 0.936 | 0.0742 | G | 0.17 | C | 0.83 |
| hCV25652744 | 1.0000 | 4E+12 | 0 | | 0.0261 | A | 0.05 | C | 0.95 |
| hCV25652744 | 0.0373 | 0.34 | 0.124 | 0.939 | 0.0261 | A | 0.05 | C | 0.95 |
| hCV25652744 | 0.1210 | 0.83 | 0.653 | 1.051 | 0.0261 | A | 0.05 | C | 0.95 |
| hCV1026586 | 0.0160 | 0.75 | 0.60 | 0.95 | 0.0780 | A | 0.22 | G | 0.78 |
| hCV1026586 | 0.2000 | 2.15 | 0.66 | 6.97 | 0.0780 | A | 0.22 | G | 0.78 |
| hCV11466848 | 0.0003 | 0.54 | 0.38 | 0.75 | 0.0020 | A | 0.28 | G | 0.72 |
| hCV11466848 | 0.5200 | 1.11 | 0.81 | 1.52 | 0.0020 | A | 0.28 | G | 0.72 |
| hCV11513719 | 0.0019 | 0.54 | 0.36 | 0.80 | 0.0180 | C | 0.82 | T | 0.18 |
| hCV11513719 | 0.7800 | 0.96 | 0.73 | 1.27 | 0.0180 | C | 0.82 | T | 0.18 |
| hCV1323634 | 0.0031 | 0.69 | 0.54 | 0.88 | 0.0074 | C | 0.43 | T | 0.57 |
| hCV1323634 | 0.1000 | 1.63 | 0.91 | 2.93 | 0.0074 | C | 0.43 | T | 0.57 |
| hCV1323669 | 0.0048 | 0.70 | 0.54 | 0.89 | 0.0190 | A | 0.44 | G | 0.58 |
| hCV1323669 | 0.2100 | 1.42 | 0.82 | 2.44 | 0.0190 | A | 0.44 | G | 0.56 |
| hCV1729928 | 0.0096 | 0.73 | 0.57 | 0.93 | 0.0680 | A | 0.66 | G | 0.34 |
| hCV1729928 | 0.3600 | 1.39 | 0.69 | 2.79 | 0.0880 | A | 0.66 | G | 0.34 |
| hCV1948599 | 0.0041 | 0.68 | 0.52 | 0.88 | 0.0320 | A | 0.49 | C | 0.51 |
| hCV1948599 | 0.4600 | 1.18 | 0.76 | 1.82 | 0.0320 | A | 0.49 | C | 0.51 |
| hCV2554615 | 0.0098 | 0.72 | 0.56 | 0.92 | 0.0580 | C | 0.58 | G | 0.42 |
| hCV2554615 | 0.3900 | 1.28 | 0.73 | 2.27 | 0.0580 | C | 0.58 | G | 0.42 |
| hCV2554721 | 0.0005 | 0.62 | 0.47 | 0.81 | 0.0015 | A | 0.46 | G | 0.54 |
| hCV2554721 | 0.1200 | 1.39 | 0.91 | 2.12 | 0.0015 | A | 0.46 | G | 0.54 |
| hCV260164 | 0.0160 | 0.75 | 0.60 | 0.95 | 0.0720 | G | 0.24 | T | 0.76 |
| hCV260164 | 0.1900 | 2.19 | 0.67 | 7.10 | 0.0720 | G | 0.24 | T | 0.76 |
| hCV2762168 | 0.0052 | 0.63 | 0.46 | 0.87 | 0.0600 | C | 0.74 | T | 0.26 |
| hCV2762168 | 0.8700 | 0.97 | 0.71 | 1.34 | 0.0600 | C | 0.74 | T | 0.26 |
| hCV2781953 | 0.0220 | 0.76 | 0.6 | 0.96 | 0.0870 | G | 0.81 | T | 0.19 |
| hCV2781953 | 0.2000 | 2.15 | 0.66 | 7.02 | 0.0870 | G | 0.81 | T | 0.19 |
| hCV29011391 | 0.0150 | 0.75 | 0.59 | 0.95 | 0.0790 | A | 0.76 | G | 0.24 |
| hCV29011391 | 0.2100 | 2.13 | 0.66 | 6.91 | 0.0790 | A | 0.76 | G | 0.24 |
| hCV29135108 | 0.0009 | 0.58 | 0.43 | 0.80 | 0.0076 | A | 0.69 | C | 0.31 |
| hCV29135108 | 0.5900 | 1.10 | 0.78 | 1.53 | 0.0076 | A | 0.69 | C | 0.31 |
| hCV30264691 | 0.0140 | 0.74 | 0.59 | 0.94 | 0.0910 | G | 0.30 | T | 0.70 |
| hCV30264691 | 0.3000 | 1.53 | 0.69 | 3.41 | 0.0910 | G | 0.30 | T | 0.70 |
| hCV30606396 | 0.0074 | 0.58 | 0.39 | 0.86 | 0.0650 | C | 0.82 | T | 0.18 |
| hCV30606396 | 0.5400 | 0.92 | 0.70 | 1.21 | 0.0650 | C | 0.82 | T | 0.18 |
| hCV31237961 | 0.0046 | 0.69 | 0.54 | 0.89 | 0.0260 | A | 0.53 | C | 0.47 |
| hCV31237961 | 0.3100 | 1.31 | 0.78 | 2.2 | 0.0260 | A | 0.53 | C | 0.47 |
| hCV3168675 | 0.0066 | 0.67 | 0.5 | 0.89 | 0.0790 | A | 0.64 | G | 0.36 |
| hCV3168675 | 0.9500 | 1.01 | 0.7 | 1.45 | 0.0790 | A | 0.64 | G | 0.36 |
| hCV3170445 | 0.0032 | 0.65 | 0.49 | 0.87 | 0.0260 | C | 0.61 | T | 0.39 |
| hCV3170445 | 0.5400 | 1.13 | 0.76 | 1.67 | 0.0260 | C | 0.61 | T | 0.39 |
| hCV3170459 | 0.0079 | 0.71 | 0.55 | 0.91 | 0.0550 | C | 0.58 | T | 0.42 |
| hCV3170459 | 0.4200 | 1.25 | 0.72 | 2.16 | 0.0550 | C | 0.58 | T | 0.42 |
| hCV3242919 | 0.0110 | 0.74 | 0.58 | 0.93 | 0.0490 | A | 0.71 | C | 0.29 |
| hCV3242919 | 0.1800 | 1.78 | 0.76 | 4.17 | 0.0490 | A | 0.71 | C | 0.29 |
| hCV3242952 | 0.0035 | 0.57 | 0.39 | 0.83 | 0.0320 | A | 0.21 | G | 0.79 |
| hCV3242952 | 0.7700 | 0.96 | 0.72 | 1.28 | 0.0320 | A | 0.21 | G | 0.79 |
| hCV610861 | 0.0110 | 0.72 | 0.56 | 0.93 | 0.0900 | C | 0.43 | T | 0.57 |
| hCV610861 | 0.4800 | 1.23 | 0.7 | 2.16 | 0.0900 | C | 0.43 | T | 0.57 |
| hCV7501549 | 0.0063 | 0.69 | 0.53 | 0.9 | 0.0620 | C | 0.50 | T | 0.50 |
| hCV7501549 | 0.5800 | 1.13 | 0.73 | 1.77 | 0.0620 | C | 0.50 | T | 0.50 |
| hCV7537517 | 0.0100 | 0.73 | 0.58 | 0.93 | 0.0320 | C | 0.64 | G | 0.36 |
| hCV7537517 | 0.1500 | 1.75 | 0.82 | 3.77 | 0.0320 | C | 0.64 | G | 0.36 |
| hCV7910239 | 0.0140 | 0.74 | 0.58 | 0.94 | 0.0850 | A | 0.66 | G | 0.34 |
| hCV7910239 | 0.3200 | 1.43 | 0.71 | 2.87 | 0.0850 | A | 0.66 | G | 0.34 |
| hCV8420416 | 0.0200 | 0.76 | 0.61 | 0.96 | 0.0770 | C | 0.84 | T | 0.16 |
| hCV8420416 | 0.1500 | 3.29 | 0.64 | 16.97 | 0.0770 | C | 0.84 | T | 0.16 |
| hCV8785827 | 0.0038 | 0.62 | 0.45 | 0.86 | 0.0430 | A | 0.26 | G | 0.74 |
| hCV8785827 | 0.9400 | 0.99 | 0.72 | 1.36 | 0.0430 | A | 0.26 | G | 0.74 |
| hCV8892418 | 0.0024 | 0.59 | 0.42 | 0.83 | 0.0220 | A | 0.71 | G | 0.29 |
| hCV8892418 | 0.9600 | 1.01 | 0.74 | 1.37 | 0.0220 | A | 0.71 | G | 0.29 |
| hCV11678789 | 0.6900 | 0.95 | 0.73 | 1.23 | 0.0058 | G | 0.48 | T | 0.52 |
| hCV11678789 | 0.0007 | 0.44 | 0.27 | 0.71 | 0.0058 | G | 0.48 | T | 0.52 |
| hCV11864162 | 0.7400 | 0.95 | 0.71 | 1.28 | 0.0660 | A | 0.66 | C | 0.34 |
| hCV11864162 | 0.0074 | 0.62 | 0.43 | 0.88 | 0.0660 | A | 0.66 | C | 0.34 |
| hCV1239369 | 0.7300 | 0.95 | 0.71 | 1.27 | 0.0510 | A | 0.35 | C | 0.65 |
| hCV1239369 | 0.0051 | 0.6 | 0.42 | 0.86 | 0.0510 | A | 0.35 | C | 0.65 |

TABLE 21-continued

CHD Risk Reduction by Pravastatin in CARE According to SNP Genotypes

| | | | | | | | | | |
|---|---|---|---|---|---|---|---|---|---|
| hCV1488444 | 0.1400 | 0.84 | 0.66 | 1.06 | 0.0910 | G | 0.71 | T | 0.29 |
| hCV1488444 | 0.0240 | 0.37 | 0.15 | 0.88 | 0.0910 | G | 0.71 | T | 0.29 |
| hCV1489995 | 0.2900 | 0.88 | 0.68 | 1.12 | 0.0440 | C | 0.63 | G | 0.37 |
| hCV1489995 | 0.0090 | 0.45 | 0.25 | 0.82 | 0.0440 | C | 0.63 | G | 0.37 |
| hcV15870728 | 0.4000 | 0.89 | 0.68 | 1.16 | 0.0890 | C | 0.53 | T | 0.47 |
| hCV15870728 | 0.0130 | 0.57 | 0.36 | 0.89 | 0.0890 | C | 0.53 | T | 0.47 |
| hCV1802755 | 0.0920 | 0.82 | 0.65 | 1.03 | 0.0880 | C | 0.18 | T | 0.82 |
| hCV1802755 | 0.0470 | 0.21 | 0.05 | 0.98 | 0.0880 | C | 0.18 | T | 0.82 |
| hCV2557331 | 0.2600 | 0.87 | 0.68 | 1.11 | 0.0830 | C | 0.42 | T | 0.58 |
| hCV2557331 | 0.0190 | 0.5 | 0.28 | 0.89 | 0.0830 | C | 0.42 | T | 0.58 |
| hCV2632070 | 0.4300 | 1.21 | 0.75 | 1.94 | 0.0400 | A | 0.88 | G | 0.12 |
| hCV2632070 | 0.0050 | 0.69 | 0.53 | 0.89 | 0.0400 | A | 0.88 | G | 0.12 |
| hCV2632498 | 0.6200 | 1.12 | 0.71 | 1.78 | 0.0780 | C | 0.87 | G | 0.13 |
| hCV2632498 | 0.0076 | 0.7 | 0.54 | 0.91 | 0.0780 | C | 0.87 | G | 0.13 |
| hCV2632544 | 0.3400 | 1.25 | 0.79 | 2.00 | 0.0230 | C | 0.88 | T | 0.12 |
| hCV2632544 | 0.0037 | 0.68 | 0.52 | 0.88 | 0.0230 | C | 0.88 | T | 0.12 |
| hCV28974083 | 0.4500 | 0.90 | 0.69 | 1.18 | 0.0510 | A | 0.48 | G | 0.52 |
| hCV28974083 | 0.0067 | 0.54 | 0.35 | 0.84 | 0.0510 | A | 0.48 | G | 0.52 |
| hCV31145250 | 0.8600 | 0.97 | 0.72 | 1.31 | 0.0450 | A | 0.66 | C | 0.34 |
| hCV31145250 | 0.0053 | 0.61 | 0.43 | 0.86 | 0.0450 | A | 0.66 | C | 0.34 |
| hCV31528409 | 0.8400 | 0.97 | 0.7 | 1.34 | 0.0850 | A | 0.71 | G | 0.29 |
| hCV31528409 | 0.0085 | 0.65 | 0.47 | 0.9 | 0.0850 | A | 0.71 | G | 0.29 |
| hCV31954792 | 0.1400 | 0.84 | 0.66 | 1.06 | 0.0830 | A | 0.72 | C | 0.28 |
| hCV31954792 | 0.0280 | 0.38 | 0.16 | 0.9 | 0.0830 | A | 0.72 | C | 0.28 |
| hCV461035 | 0.5300 | 0.91 | 0.69 | 1.21 | 0.0970 | C | 0.40 | T | 0.60 |
| hCV461035 | 0.0094 | 0.61 | 0.42 | 0.89 | 0.0970 | C | 0.40 | T | 0.60 |
| hCV601961 | 0.2200 | 0.86 | 0.67 | 1.10 | 0.0950 | A | 0.38 | G | 0.62 |
| hCV601961 | 0.0210 | 0.51 | 0.28 | 0.90 | 0.0950 | A | 0.38 | G | 0.62 |
| hCV8785824 | 0.2300 | 0.86 | 0.68 | 1.1 | 0.0200 | A | 0.33 | C | 0.67 |
| hCV8785824 | 0.0060 | 0.33 | 0.15 | 0.73 | 0.0200 | A | 0.33 | C | 0.67 |
| hCV9581635 | 0.8500 | 0.97 | 0.72 | 1.31 | 0.0440 | C | 0.66 | G | 0.34 |
| hCV9581635 | 0.0051 | 0.61 | 0.43 | 0.86 | 0.0440 | C | 0.66 | G | 0.34 |
| hCV9586862 | 0.7600 | 0.95 | 0.71 | 1.29 | 0.0570 | C | 0.66 | T | 0.34 |
| hCV9586862 | 0.0057 | 0.61 | 0.43 | 0.87 | 0.0570 | C | 0.66 | T | 0.34 |
| hDV76976592 | 0.8100 | 0.96 | 0.71 | 1.31 | 0.0540 | A | 0.34 | G | 0.66 |
| hDV76976592 | 0.0057 | 0.61 | 0.43 | 0.87 | 0.0540 | A | 0.34 | G | 0.66 |
| hCV11568668 | 0.2300 | 0.78 | 0.52 | 1.17 | 0.0343 | A | 0.49 | G | 0.51 |
| hCV11568668 | 0.9100 | 1.02 | 0.73 | 1.43 | 0.0343 | A | 0.49 | G | 0.51 |
| hCV11568668 | 0.0028 | 0.47 | 0.29 | 0.77 | 0.0343 | A | 0.49 | G | 0.51 |
| hCV2221541 | 0.0066 | 0.30 | 0.12 | 0.71 | 0.0367 | C | 0.29 | T | 0.71 |
| hCV2221541 | 0.9400 | 0.99 | 0.68 | 1.42 | 0.0367 | C | 0.29 | T | 0.71 |
| hCV2221541 | 0.0910 | 0.77 | 0.56 | 1.04 | 0.0367 | C | 0.29 | T | 0.71 |
| hCV601962 | 0.0088 | 0.60 | 0.41 | 0.88 | 0.0198 | A | 0.62 | G | 0.38 |
| hCV601962 | 0.6100 | 1.09 | 0.78 | 1.52 | 0.0198 | A | 0.62 | G | 0.38 |
| hCV601962 | 0.0240 | 0.51 | 0.29 | 0.92 | 0.0198 | A | 0.62 | G | 0.38 |
| hCV8369472 | 0.0610 | 0.68 | 0.46 | 1.02 | 0.0471 | A | 0.48 | G | 0.52 |
| hCV8369472 | 0.7100 | 1.07 | 0.76 | 1.50 | 0.0471 | A | 0.48 | G | 0.52 |
| hCV8369472 | 0.0088 | 0.53 | 0.33 | 0.85 | 0.0471 | A | 0.48 | G | 0.52 |
| hCV22303 | 0.3600 | 0.87 | 0.65 | 1.17 | 0.0391 | A | 0.78 | G | 0.22 |
| hCV22303 | 0.0038 | 0.55 | 0.37 | 0.82 | 0.0391 | A | 0.78 | G | 0.22 |
| hCV22303 | 0.2400 | 1.73 | 0.69 | 4.33 | 0.0391 | A | 0.78 | G | 0.22 |
| hCV601946 | 0.0410 | 0.54 | 0.29 | 0.97 | 0.0203 | A | 0.37 | G | 0.63 |
| hCV601946 | 0.5700 | 1.1 | 0.79 | 1.53 | 0.0203 | A | 0.37 | G | 0.63 |
| hCV601946 | 0.0077 | 0.6 | 0.41 | 0.87 | 0.0203 | A | 0.37 | G | 0.63 |
| hCV922535 | 0.7300 | 0.95 | 0.69 | 1.3 | 0.0842 | A | 0.70 | G | 0.30 |
| hCV922535 | 0.0032 | 0.58 | 0.41 | 0.84 | 0.0842 | A | 0.70 | G | 0.30 |
| hCV922535 | 0.7000 | 1.17 | 0.52 | 2.63 | 0.0842 | A | 0.70 | G | 0.30 |
| hDV70797856 | 1.0000 | 1E+09 | 0 | Inf | 0.0397 | C | 0.11 | T | 0.89 |
| hDV70797856 | 0.0084 | 0.52 | 0.32 | 0.84 | 0.0397 | C | 0.11 | T | 0.89 |
| hDV70797856 | 0.3000 | 0.87 | 0.67 | 1.13 | 0.0397 | C | 0.11 | T | 0.89 |
| hCV11856381 | 0.0018 | 0.65 | 0.49 | 0.85 | 0.0420 | A | 0.54 | G | 0.46 |
| hCV11856381 | 0.4300 | 1.26 | 0.70 | 2.27 | 0.0420 | A | 0.54 | G | 0.46 |
| hCV16140621 | 0.0045 | 0.52 | 0.33 | 0.82 | 0.0810 | A | 0.17 | T | 0.83 |
| hCV16140621 | 0.2500 | 0.84 | 0.63 | 1.13 | 0.0810 | A | 0.17 | T | 0.83 |
| hCV1682755 | 0.0021 | 0.63 | 0.47 | 0.85 | 0.0780 | C | 0.48 | T | 0.52 |
| hCV1682755 | 0.9200 | 1.02 | 0.65 | 1.62 | 0.0780 | C | 0.48 | T | 0.52 |
| hCV27480853 | 0.0022 | 0.65 | 0.49 | 0.85 | 0.0820 | C | 0.44 | T | 0.56 |
| hCV27480853 | 0.7200 | 1.10 | 0.64 | 1.88 | 0.0820 | C | 0.44 | T | 0.56 |
| hCV2948766 | 0.0022 | 0.65 | 0.50 | 0.86 | 0.0660 | A | 0.43 | G | 0.57 |
| hCV2948766 | 0.5200 | 1.22 | 0.67 | 2.24 | 0.0660 | A | 0.43 | G | 0.57 |
| hCV30534667 | 0.0012 | 0.55 | 0.38 | 0.79 | 0.0330 | A | 0.30 | G | 0.70 |
| hCV30534667 | 0.7300 | 0.94 | 0.67 | 1.32 | 0.0330 | A | 0.30 | G | 0.70 |
| hCV30764105 | 0.0008 | 0.57 | 0.41 | 0.79 | 0.0240 | C | 0.63 | G | 0.37 |
| hCV30764105 | 0.9700 | 1.01 | 0.69 | 1.47 | 0.0240 | C | 0.63 | G | 0.37 |
| hCV11231076 | 0.6200 | 1.11 | 0.73 | 1.69 | 0.0130 | C | 0.82 | T | 0.18 |
| hCV11231076 | 0.0005 | 0.58 | 0.42 | 0.79 | 0.0130 | C | 0.82 | T | 0.18 |
| hCV11466079 | 0.1000 | 0.80 | 0.61 | 1.04 | 0.0830 | A | 0.61 | G | 0.39 |
| hCV11466079 | 0.0120 | 0.43 | 0.23 | 0.83 | 0.0830 | A | 0.61 | G | 0.39 |

TABLE 21-continued

CHD Risk Reduction by Pravastatin in CARE According to SNP Genotypes

| | | | | | | | | | |
|---|---|---|---|---|---|---|---|---|---|
| hCV11592758 | 0.9000 | 1.03 | 0.68 | 1.54 | 0.0360 | C | 0.82 | T | 0.18 |
| hCV11592758 | 0.0010 | 0.59 | 0.43 | 0.81 | 0.0360 | C | 0.82 | T | 0.18 |
| hCV11703905 | 0.5000 | 0.89 | 0.64 | 1.25 | 0.0730 | C | 0.69 | T | 0.31 |
| hCV11703905 | 0.0026 | 0.57 | 0.39 | 0.82 | 0.0730 | C | 0.69 | T | 0.31 |
| hCV2195496 | 0.1300 | 0.81 | 0.61 | 1.06 | 0.0950 | C | 0.44 | T | 0.56 |
| hCV2195496 | 0.0099 | 0.47 | 0.27 | 0.84 | 0.0950 | C | 0.44 | T | 0.56 |
| hCV28960526 | 0.8400 | 1.04 | 0.70 | 1.54 | 0.0220 | A | 0.77 | T | 0.23 |
| hCV28960526 | 0.0007 | 0.57 | 0.42 | 0.79 | 0.0220 | A | 0.77 | T | 0.23 |
| hCV29480044 | 0.8100 | 1.05 | 0.71 | 1.55 | 0.0210 | C | 0.78 | T | 0.22 |
| hCV29480044 | 0.0008 | 0.58 | 0.42 | 0.79 | 0.0210 | C | 0.78 | T | 0.22 |
| hCV30136303 | 0.6000 | 0.92 | 0.68 | 1.25 | 0.0130 | C | 0.40 | G | 0.60 |
| hCV30136303 | 0.0005 | 0.48 | 0.31 | 0.72 | 0.0130 | C | 0.40 | G | 0.60 |
| hCV30454150 | 0.8200 | 1.05 | 0.71 | 1.55 | 0.0200 | C | 0.78 | T | 0.22 |
| hCV30454150 | 0.0007 | 0.57 | 0.42 | 0.79 | 0.0200 | C | 0.78 | T | 0.22 |
| hCV487868 | 0.7200 | 0.94 | 0.66 | 1.34 | 0.0490 | C | 0.26 | T | 0.74 |
| hCV487868 | 0.0015 | 0.57 | 0.40 | 0.81 | 0.0490 | C | 0.26 | T | 0.74 |
| hCV904974 | 0.0790 | 0.79 | 0.61 | 1.03 | 0.0980 | C | 0.61 | T | 0.39 |
| hCV904974 | 0.0160 | 0.41 | 0.20 | 0.85 | 0.0980 | C | 0.61 | T | 0.39 |
| hCV15954645 | 0.8600 | 1.04 | 0.65 | 1.69 | 0.0421 | A | 0.53 | T | 0.47 |
| hCV15954645 | 0.0004 | 0.53 | 0.37 | 0.75 | 0.0421 | A | 0.53 | T | 0.47 |
| hCV15954645 | 0.8200 | 0.94 | 0.56 | 1.59 | 0.0421 | A | 0.53 | T | 0.47 |
| hCV29684678 | 0.3000 | 1.72 | 0.61 | 4.83 | 0.0984 | C | 0.28 | G | 0.72 |
| hCV29684678 | 0.0045 | 0.57 | 0.38 | 0.84 | 0.0984 | C | 0.28 | G | 0.72 |
| hCV29684678 | 0.2000 | 0.80 | 0.57 | 1.12 | 0.0984 | C | 0.28 | G | 0.72 |
| hCV621313 | 0.4300 | 2.64 | 0.24 | 29.12 | 0.0972 | C | 0.13 | T | 0.87 |
| hCV621313 | 0.0048 | 0.46 | 0.27 | 0.79 | 0.0972 | C | 0.13 | T | 0.87 |
| hCV621313 | 0.1500 | 0.81 | 0.61 | 1.08 | 0.0972 | C | 0.13 | T | 0.87 |
| hDV70938014 | 0.9200 | 0.98 | 0.60 | 1.59 | 0.0770 | A | 0.52 | G | 0.48 |
| hDV70938014 | 0.0009 | 0.55 | 0.38 | 0.78 | 0.0770 | A | 0.52 | G | 0.48 |
| hDV70938014 | 0.8800 | 0.96 | 0.58 | 1.60 | 0.0770 | A | 0.52 | G | 0.48 |
| hCV11446935 | 0.8400 | 1.05 | 0.67 | 1.63 | 0.0560 | G | 0.51 | T | 0.49 |
| hCV11446935 | 0.0019 | 0.62 | 0.46 | 0.84 | 0.0560 | G | 0.51 | T | 0.49 |
| hCV10048483 | 0.5000 | 1.25 | 0.66 | 2.38 | 0.0730 | C | 0.38 | T | 0.62 |
| hCV10048483 | 0.0023 | 0.66 | 0.50 | 0.86 | 0.0730 | C | 0.38 | T | 0.62 |

TABLE 22

SNPs Associated with Risk of CHD in Placebo Arm of CARE

| hCV | rs | gene symbol | Allele1 | Allele2 (reference allele) | EVENTS (placebo arm) | TOTAL PATIENTS (placebo arm) |
|---|---|---|---|---|---|---|
| hCV11513719 | rs2967605 | ELAVL1 | T | C | 166 | 1367 |
| hCV1323634 | rs287475 | | T | C | 167 | 1372 |
| hCV1323669 | rs287354 | | G | A | 166 | 1373 |
| hCV1729928 | rs10509384 | KCNMA1 | A | G | 167 | 1368 |
| hCV2221541 | rs739161 | | T | C | 167 | 1373 |
| hCV260164 | rs6754295 | | T | G | 167 | 1373 |
| hCV29011391 | rs7557067 | | A | G | 167 | 1373 |
| hCV29135108 | rs6743779 | KLF7 | C | A | 167 | 1372 |
| hCV3242952 | rs2000571 | | A | G | 167 | 1372 |
| hCV7537517 | rs1501908 | | C | G | 166 | 1372 |
| hCV7910239 | rs1541296 | FVT1 | A | G | 166 | 1370 |
| hCV11466848 | rs1805419 | BAX | A | G | 167 | 1373 |
| hCV2554721 | rs7315519 | RPH3A | A | G | 167 | 1372 |
| hCV2762168 | rs3939286 | | T | C | 167 | 1371 |
| hCV31237961 | rs11950562 | SLC22A4 | A | C | 167 | 1371 |
| hCV3168675 | rs469930 | | G | A | 167 | 1371 |
| hCV3170445 | rs272893 | SLC22A4 | T | C | 167 | 1373 |
| hCV610861 | rs636887 | | T | C | 167 | 1373 |
| hCV8785824 | rs1412426 | | A | C | 167 | 1369 |
| hCV8785827 | rs992969 | IL33 | A | G | 167 | 1371 |
| hDV70797856 | rs17006217 | | C | T | 167 | 1373 |
| hCV1026586 | rs673548 | APOB | G | A | 167 | 1372 |
| hCV11568668 | rs1317538 | KCNQ5 | A | G | 166 | 1374 |
| hCV1489995 | rs4013819 | LOC392281 | G | C | 167 | 1372 |
| hCV1948599 | rs504527 | CSMD2 | C | A | 167 | 1370 |
| hCV601962 | rs544543 | ZNF568 | G | A | 167 | 1371 |
| hCV601961 | rs568654 | ZNF568 | A | G | 167 | 1373 |
| hCV8369472 | rs1447351 | MTNR1B | G | A | 167 | 1373 |
| hCV461035 | rs7746448 | | T | C | 167 | 1373 |
| hCV30606396 | rs10438978 | | T | C | 167 | 1372 |
| hCV22303 | rs4552916 | | G | A | 167 | 1373 |

TABLE 22-continued

SNPs Associated with Risk of CHD in Placebo Arm of CARE

| | | | | | | |
|---|---|---|---|---|---|---|
| hCV11856381 | rs2197089 | | A | G | 148 | 1371 |
| hCV15954645 | rs2954029 | | A | T | 148 | 1371 |
| hCV28960526 | rs6853079 | TSPAN5 | A | T | 148 | 1374 |
| hCV29480044 | rs10516433 | TSPAN5 | C | T | 148 | 1375 |
| hCV29684678 | rs10486788 | | C | G | 147 | 1370 |
| hCV30454150 | rs10516434 | TSPAN5 | C | T | 148 | 1373 |
| hCV30136303 | rs6914527 | | G | C | 148 | 1373 |
| hCV2195496 | rs4982795 | | C | T | 147 | 1370 |
| hCV2948766 | rs4684343 | CNTN4 | G | A | 147 | 1370 |
| hCV1253630 | rs2071307 | ELN | A | G | 162 | 1371 |
| hCV15746640 | rs41271951 | CTSS | G | A | 165 | 1379 |
| hCV16044337 | rs2569491 | KLK14 | A | G | 164 | 1373 |
| hCV16179493 | rs2108622 | CYP4F2 | T | C | 165 | 1379 |
| hCV1647371 | rs3025000 | VEGFA | T | C | 161 | 1354 |
| hCV1843175 | rs3745535 | KLK10 | A | C | 165 | 1378 |
| hCV2230606 | rs13268 | FBLN1 | G | A | 164 | 1380 |
| hCV2276802 | rs381418 | GBA | C | A | 164 | 1380 |
| hCV2536595 | rs704 | VTN | A | G | 165 | 1383 |
| hCV25472673 | rs1805081 | NPC1 | C | T | 164 | 1380 |
| hCV25596880 | rs4647297 | CASP2 | C | G | 165 | 1380 |
| hCV25603879 | rs11542844 | SCNN1A | T | C | 165 | 1376 |
| hCV25610819 | rs8176740 | | T | A | 165 | 1374 |
| hCV25614016 | rs7607759 | CAPN10 | G | A | 165 | 1379 |
| hCV25617571 | rs2232580 | LBP | T | C | 165 | 1382 |
| hCV25629396 | rs3729823 | MYH7 | C | G | 164 | 1378 |
| hCV25631989 | rs1135983 | ATF6 | T | C | 158 | 1346 |
| hCV25644901 | | ITGA9 | G | A | 165 | 1379 |
| hCV25926178 | rs12882130 | MARK3 | G | C | 161 | 1352 |
| hCV25926771 | rs4906321 | MARK3 | C | T | 161 | 1350 |
| hCV25927605 | | HLA-DPA1 | T | C | 165 | 1375 |
| hCV25941408 | rs28497577 | MYLK | T | G | 163 | 1381 |
| hCV2633049 | rs2302006 | CCL24 | G | T | 164 | 1378 |
| hCV2658421 | rs3176975 | APOH | A | C | 164 | 1376 |
| hCV2741051 | rs2230806 | ABCA1 | T | C | 165 | 1382 |
| hCV2741083 | rs4149313 | ABCA1 | C | T | 165 | 1381 |
| hCV2983035 | rs9527026 | KL | A | G | 163 | 1377 |
| hCV2983036 | rs9527025 | KL | C | G | 165 | 1376 |
| hCV3026189 | rs11739136 | KCNIP1 | T | C | 165 | 1383 |
| hCV435368 | rs2812 | PECAM1 | T | C | 164 | 1380 |
| hCV529706 | rs428785 | ADAMTS1 | C | G | 164 | 1375 |
| hCV529710 | rs402007 | ADAMTS1 | C | G | 165 | 1382 |
| hCV5478 | rs1800574 | TCF1 | T | C | 165 | 1382 |
| hCV7499212 | rs1800127 | LRP1 | T | C | 165 | 1379 |
| hCV7514870 | rs1041981 | LTA | A | C | 165 | 1381 |
| hCV7577801 | rs11876 | SLC9A3R2 | T | C | 165 | 1374 |
| hCV783184 | rs510335 | | T | G | 164 | 1379 |
| hCV7900503 | rs3732379 | CX3CR1 | T | C | 165 | 1381 |
| hCV8718197 | rs1050998 | CXCL16 | G | A | 165 | 1383 |
| hCV8784787 | rs688976 | | A | C | 165 | 1381 |
| hCV8901525 | rs861539 | KLC1 | A | G | 161 | 1352 |
| hCV8921288 | rs1060621 | GAPDH | C | A | 158 | 1347 |
| hCV9077561 | rs1801274 | FCGR2A | G | A | 165 | 1381 |
| hCV2741051 | rs2230806 | ABCA1 | T | C | 165 | 1382 |
| hCV435368 | rs2812 | PECAM1 | T | C | 164 | 1380 |
| hCV8921288 | rs1060621 | GAPDH | C | A | 158 | 1347 |
| hCV11689916 | | | A | T | 158 | 1314 |
| hCV12020339 | rs4531 | DBH | T | G | 165 | 1374 |
| hCV1243283 | rs1716 | ITGAE | A | G | 165 | 1379 |
| hCV1552894 | rs434473 | ALOX12 | G | A | 165 | 1377 |
| hCV1552900 | rs1126667 | ALOX12 | A | G | 165 | 1379 |
| hCV15851335 | rs17610395 | CPT1A | T | C | 164 | 1379 |
| hCV15954277 | rs2236379 | PRKCQ | A | G | 165 | 1383 |
| hCV16173091 | rs2241883 | FABP1 | C | T | 165 | 1381 |
| hCV1741111 | rs1764391 | C1orf212 | T | C | 165 | 1380 |
| hCV2143205 | rs9666607 | CD44 | A | G | 165 | 1383 |
| hCV22274761 | rs11575194 | IGFBP5 | A | G | 165 | 1378 |
| hCV2503034 | rs1132356 | BAIAP3 | A | C | 164 | 1372 |
| hCV2531086 | rs10406069 | CD22 | A | G | 165 | 1379 |
| hCV25473098 | rs2241883 | FABP1 | G | A | 163 | 1371 |
| hCV25610774 | rs8176748 | | T | C | 165 | 1382 |
| hCV25637309 | rs3204849 | CCRL2 | A | T | 165 | 1378 |
| hCV25651174 | rs9277356 | HLA-DPB1 | G | A | 165 | 1375 |
| hCV2769554 | rs1805010 | IL4R | G | A | 165 | 1378 |
| hCV370782 | rs9841174 | SERPINI2 | C | T | 165 | 1376 |
| hCV549926 | rs1057141 | Tap1or | C | T | 165 | 1376 |
| hCV7490135 | rs1805082 | NPC1 | C | T | 165 | 1376 |
| hCV8804621 | rs1390938 | SLC18A1 | A | G | 164 | 1376 |
| hCV8851065 | rs9277343 | HLA-DPA1 | G | C | 165 | 1383 |

TABLE 22-continued

SNPs Associated with Risk of CHD in Placebo Arm of CARE

| | | | | | | |
|---|---|---|---|---|---|---|
| hCV9604851 | rs1805002 | CCKBR | A | G | 165 | 1380 |
| hCV997884 | rs512770 | | A | G | 164 | 1370 |
| hCV3135085 | rs10795446 | CUBN | G | T | 164 | 1370 |
| hCV3215409 | rs267561 | ITGA9 | G | A | 165 | 1381 |
| hCV7494810 | rs1058587 | GDF15 | G | C | 165 | 1379 |
| hCV783138 | rs6046 | F10 | A | G | 163 | 1377 |
| hCV795442 | rs375947 | IL12RB1 | G | A | 164 | 1381 |
| hCV818008 | rs5918 | ITGB3 | C | T | 165 | 1381 |

| hCV | Allele1 Freq. | Allele2 Freq. | HR | HR95L | HR95U | P value | Model | Endpoint |
|---|---|---|---|---|---|---|---|---|
| hCV11513719 | 0.18 | 0.82 | 1.49 | 1.09 | 2.03 | 0.012 | dom | endpt1 |
| hCV1323634 | 0.57 | 0.43 | 1.90 | 1.17 | 3.10 | 0.01 | dom | endpt1 |
| hCV1323669 | 0.56 | 0.44 | 1.62 | 1.04 | 2.54 | 0.034 | dom | endpt1 |
| hCV1729928 | 0.66 | 0.34 | 1.59 | 0.92 | 2.75 | 0.096 | dom | endpt1 |
| hCV2221541 | 0.71 | 0.29 | 0.65 | 0.39 | 1.07 | 0.087 | dom | endpt1 |
| hCV260164 | 0.76 | 0.24 | 2.37 | 0.88 | 6.39 | 0.088 | dom | endpt1 |
| hCV29011391 | 0.76 | 0.24 | 2.34 | 0.87 | 6.30 | 0.094 | dom | endpt1 |
| hCV29135108 | 0.32 | 0.68 | 1.42 | 1.04 | 1.94 | 0.027 | dom | endpt1 |
| hCV3242952 | 0.22 | 0.78 | 1.31 | 0.96 | 1.78 | 0.084 | dom | endpt1 |
| hCV7537517 | 0.64 | 0.36 | 2.37 | 1.25 | 4.48 | 0.0083 | dom | endpt1 |
| hCV7910239 | 0.66 | 0.34 | 1.64 | 0.95 | 2.83 | 0.077 | dom | endpt1 |
| hCV11466848 | 0.28 | 0.72 | 1.37 | 1.01 | 1.87 | 0.041 | dom | endpt1 |
| hCV2554721 | 0.46 | 0.54 | 1.45 | 1.01 | 2.09 | 0.046 | dom | endpt1 |
| hCV2762168 | 0.26 | 0.74 | 1.47 | 1.09 | 2.00 | 0.013 | dom | endpt1 |
| hCV31237961 | 0.54 | 0.46 | 1.62 | 1.05 | 2.49 | 0.03 | dom | endpt1 |
| hCV3168675 | 0.36 | 0.64 | 1.31 | 0.95 | 1.80 | 0.097 | dom | endpt1 |
| hCV3170445 | 0.39 | 0.61 | 1.62 | 1.15 | 2.27 | 0.0056 | dom | endpt1 |
| hCV610861 | 0.57 | 0.43 | 1.61 | 1.02 | 2.54 | 0.041 | dom | endpt1 |
| hCV8785824 | 0.33 | 0.67 | 1.45 | 1.06 | 1.98 | 0.021 | dom | endpt1 |
| hCV8785827 | 0.26 | 0.74 | 1.49 | 1.10 | 2.02 | 0.01 | dom | endpt1 |
| hDV70797856 | 0.11 | 0.89 | 1.42 | 1.01 | 2.00 | 0.044 | dom | endpt1 |
| hCV1026586 | 0.77 | 0.23 | 1.47 | 1.06 | 2.04 | 0.02 | rec | endpt1 |
| hCV11568668 | 0.48 | 0.52 | 1.34 | 0.96 | 1.87 | 0.084 | rec | endpt1 |
| hCV1489995 | 0.37 | 0.63 | 1.51 | 1.04 | 2.20 | 0.032 | rec | endpt1 |
| hCV1948599 | 0.51 | 0.49 | 1.44 | 1.04 | 1.99 | 0.03 | rec | endpt1 |
| hCV601962 | 0.38 | 0.62 | 1.44 | 0.98 | 2.11 | 0.066 | rec | endpt1 |
| hCV601961 | 0.38 | 0.62 | 1.46 | 0.99 | 2.14 | 0.055 | rec | endpt1 |
| hCV8369472 | 0.53 | 0.47 | 1.44 | 1.05 | 1.98 | 0.023 | rec | endpt1 |
| hCV461035 | 0.60 | 0.40 | 1.30 | 0.96 | 1.77 | 0.094 | rec | endpt1 |
| hCV30606396 | 0.17 | 0.83 | 1.35 | 0.98 | 1.87 | 0.064 | het | endpt1 |
| hCV22303 | 0.22 | 0.78 | 1.32 | 0.96 | 1.81 | 0.087 | het | endpt1 |
| hCV11856381 | 0.55 | 0.45 | 1.70 | 1.05 | 2.75 | 0.031 | dom | rmi |
| hCV15954645 | 0.53 | 0.47 | 0.70 | 0.47 | 1.03 | 0.072 | rec | rmi |
| hCV28960526 | 0.78 | 0.22 | 1.36 | 0.96 | 1.91 | 0.082 | rec | rmi |
| hCV29480044 | 0.78 | 0.22 | 1.35 | 0.96 | 1.91 | 0.083 | rec | rmi |
| hCV29684678 | 0.28 | 0.72 | 0.46 | 0.20 | 1.04 | 0.063 | rec | rmi |
| hCV30454150 | 0.78 | 0.22 | 1.34 | 0.95 | 1.89 | 0.09 | rec | rmi |
| hCV30136303 | 0.60 | 0.40 | 1.42 | 1.02 | 1.96 | 0.036 | rec | rmi |
| hCV2195496 | 0.44 | 0.56 | 0.69 | 0.48 | 1.00 | 0.05 | het | rmi |
| hCV2948766 | 0.58 | 0.42 | 1.62 | 0.97 | 2.69 | 0.064 | het | rmi |
| hCV1253630 | 0.41 | 0.59 | 0.71 | 0.522 | 0.977 | 0.0354 | dom | endpt1 |
| hCV15746640 | 0.08 | 0.92 | 0.55 | 0.322 | 0.932 | 0.0263 | dom | endpt1 |
| hCV16044337 | 0.31 | 0.69 | 1.35 | 0.989 | 1.846 | 0.0587 | dom | endpt1 |
| hCV16179493 | 0.31 | 0.69 | 0.76 | 0.559 | 1.032 | 0.0788 | dom | endpt1 |
| hCV1647371 | 0.33 | 0.67 | 0.7 | 0.51 | 0.949 | 0.0218 | dom | endpt1 |
| hCV1843175 | 0.36 | 0.64 | 1.4 | 1.016 | 1.921 | 0.0394 | dom | endpt1 |
| hCV2230606 | 0.02 | 0.98 | 0.35 | 0.112 | 1.097 | 0.0717 | dom | endpt1 |
| hCV2276802 | 0.37 | 0.63 | 0.72 | 0.518 | 0.994 | 0.0459 | dom | endpt1 |
| hCV2536595 | 0.47 | 0.53 | 1.71 | 1.174 | 2.497 | 0.0052 | dom | endpt1 |
| hCV25472673 | 0.39 | 0.61 | 1.47 | 1.048 | 2.062 | 0.0257 | dom | endpt1 |
| hCV25596880 | 0.06 | 0.94 | 0.6 | 0.335 | 1.085 | 0.0914 | dom | endpt1 |
| hCV25603879 | 0.03 | 0.97 | 0.43 | 0.176 | 1.046 | 0.0628 | dom | endpt1 |
| hCV25610819 | 0.23 | 0.77 | 0.76 | 0.556 | 1.051 | 0.0988 | dom | endpt1 |
| hCV25614016 | 0.16 | 0.84 | 0.63 | 0.436 | 0.92 | 0.0164 | dom | endpt1 |
| hCV25617571 | 0.08 | 0.92 | 1.58 | 1.077 | 2.311 | 0.0191 | dom | endpt1 |
| hCV25629396 | 0.01 | 0.99 | 0.16 | 0.023 | 1.163 | 0.0705 | dom | endpt1 |
| hCV25631989 | 0.08 | 0.92 | 0.5 | 0.286 | 0.89 | 0.0182 | dom | endpt1 |
| hCV25644901 | 0.05 | 0.95 | 1.93 | 1.272 | 2.939 | 0.002 | dom | endpt1 |
| hCV25926178 | 0.38 | 0.62 | 1.45 | 1.041 | 2.029 | 0.0281 | dom | endpt1 |
| hCV25926771 | 0.31 | 0.69 | 1.57 | 1.116 | 2.203 | 0.0094 | dom | endpt1 |
| hCV25927605 | 0.03 | 0.97 | 0.3 | 0.094 | 0.927 | 0.0366 | dom | endpt1 |
| hCV25941408 | 0.10 | 0.90 | 1.44 | 1.003 | 2.074 | 0.048 | dom | endpt1 |
| hCV2633049 | 0.20 | 0.81 | 0.7 | 0.498 | 0.98 | 0.038 | dom | endpt1 |
| hCV2658421 | 0.23 | 0.77 | 1.35 | 0.995 | 1.836 | 0.0539 | dom | endpt1 |
| hCV2741051 | 0.28 | 0.72 | 0.65 | 0.471 | 0.884 | 0.0064 | dom | endpt1 |
| hCV2741083 | 0.13 | 0.87 | 0.54 | 0.349 | 0.842 | 0.0064 | dom | endpt1 |

TABLE 22-continued

SNPs Associated with Risk of CHD in Placebo Arm of CARE

| | | | | | | | |
|---|---|---|---|---|---|---|---|
| hCV2983035 | 0.15 | 0.85 | 1.34 | 0.968 | 1.865 | 0.0771 | dom | endpt1 |
| hCV2983036 | 0.15 | 0.85 | 1.32 | 0.952 | 1.83 | 0.096 | dom | endpt1 |
| hCV3026189 | 0.10 | 0.90 | 0.69 | 0.442 | 1.067 | 0.095 | dom | endpt1 |
| hCV435368 | 0.47 | 0.53 | 1.61 | 1.106 | 2.353 | 0.013 | dom | endpt1 |
| hCV529706 | 0.24 | 0.76 | 1.42 | 1.043 | 1.923 | 0.026 | dom | endpt1 |
| hCV529710 | 0.24 | 0.76 | 1.42 | 1.05 | 1.933 | 0.023 | dom | endpt1 |
| hCV5478 | 0.03 | 0.97 | 0.38 | 0.142 | 1.032 | 0.0578 | dom | endpt1 |
| hCV7499212 | 0.02 | 0.98 | 1.87 | 1.081 | 3.232 | 0.0252 | dom | endpt1 |
| hCV7514870 | 0.33 | 0.67 | 1.32 | 0.968 | 1.808 | 0.0791 | dom | endpt1 |
| hCV7577801 | 0.22 | 0.78 | 0.66 | 0.475 | 0.93 | 0.017 | dom | endpt1 |
| hCV783184 | 0.12 | 0.88 | 0.69 | 0.459 | 1.048 | 0.0821 | dom | endpt1 |
| hCV7900503 | 0.28 | 0.72 | 0.72 | 0.524 | 0.975 | 0.034 | dom | endpt1 |
| hCV8718197 | 0.44 | 0.56 | 0.71 | 0.519 | 0.969 | 0.0311 | dom | endpt1 |
| hCV8784787 | 0.23 | 0.77 | 0.76 | 0.552 | 1.044 | 0.0897 | dom | endpt1 |
| hCV8901525 | 0.37 | 0.63 | 0.73 | 0.534 | 0.991 | 0.0439 | dom | endpt1 |
| hCV8921288 | 0.20 | 0.80 | 1.6 | 1.169 | 2.186 | 0.0033 | dom | endpt1 |
| hCV9077561 | 0.50 | 0.50 | 1.47 | 1 | 2.164 | 0.0499 | dom | endpt1 |
| hCV2741051 | 0.28 | 0.72 | 0.65 | 0.471 | 0.884 | 0.0064 | dom | endpt1 |
| hCV435368 | 0.47 | 0.53 | 1.61 | 1.106 | 2.353 | 0.013 | dom | endpt1 |
| hCV8921288 | 0.20 | 0.80 | 1.6 | 1.169 | 2.186 | 0.0033 | dom | endpt1 |
| hCV11689916 | 0.48 | 0.52 | 1.33 | 0.963 | 1.849 | 0.0827 | rec | endpt1 |
| hCV12020339 | 0.08 | 0.92 | 2.92 | 0.93 | 9.135 | 0.0663 | rec | endpt1 |
| hCV1243283 | 0.33 | 0.67 | 1.57 | 1.012 | 2.444 | 0.0442 | rec | endpt1 |
| hCV1552894 | 0.42 | 0.58 | 1.49 | 1.05 | 2.104 | 0.0254 | rec | endpt1 |
| hCV1552900 | 0.42 | 0.58 | 1.48 | 1.047 | 2.098 | 0.0265 | rec | endpt1 |
| hCV15851335 | 0.07 | 0.93 | 4.44 | 1.101 | 17.895 | 0.0362 | rec | endpt1 |
| hCV15954277 | 0.26 | 0.74 | 0.24 | 0.076 | 0.75 | 0.0141 | rec | endpt1 |
| hCV16173091 | 0.32 | 0.68 | 0.53 | 0.282 | 1.013 | 0.0546 | rec | endpt1 |
| hCV1741111 | 0.30 | 0.70 | 0.46 | 0.203 | 1.034 | 0.0602 | rec | endpt1 |
| hCV2143205 | 0.32 | 0.68 | 0.55 | 0.282 | 1.08 | 0.0828 | rec | endpt1 |
| hCV22274761 | 0.04 | 0.96 | 16.7 | 2.327 | 119.75 | 0.0051 | rec | endpt1 |
| hCV2503034 | 0.11 | 0.89 | 3.54 | 1.13 | 11.098 | 0.03 | rec | endpt1 |
| hCV2531086 | 0.21 | 0.79 | 0.31 | 0.076 | 1.232 | 0.0955 | rec | endpt1 |
| hCV25473098 | 0.31 | 0.69 | 0.59 | 0.319 | 1.084 | 0.0889 | rec | endpt1 |
| hCV25610774 | 0.23 | 0.77 | 0.23 | 0.056 | 0.918 | 0.0375 | rec | endpt1 |
| hCV25637309 | 0.39 | 0.61 | 0.47 | 0.278 | 0.805 | 0.0057 | rec | endpt1 |
| hCV25651174 | 0.30 | 0.70 | 0.46 | 0.216 | 0.979 | 0.044 | rec | endpt1 |
| hCV2769554 | 0.46 | 0.54 | 0.51 | 0.324 | 0.81 | 0.0042 | rec | endpt1 |
| hCV370782 | 0.38 | 0.62 | 0.54 | 0.319 | 0.924 | 0.0243 | rec | endpt1 |
| hCV549926 | 0.16 | 0.84 | 2.05 | 1.006 | 4.164 | 0.0481 | rec | endpt1 |
| hCV7490135 | 0.47 | 0.53 | 1.38 | 0.981 | 1.929 | 0.0645 | rec | endpt1 |
| hCV8804621 | 0.25 | 0.75 | 0.38 | 0.141 | 1.021 | 0.0551 | rec | endpt1 |
| hCV8851065 | 0.28 | 0.72 | 0.51 | 0.24 | 1.093 | 0.0836 | rec | endpt1 |
| hCV9604851 | 0.05 | 0.95 | 5.46 | 1.742 | 17.11 | 0.0036 | rec | endpt1 |
| hCV997884 | 0.20 | 0.80 | 0.24 | 0.059 | 0.957 | 0.0432 | rec | endpt1 |
| hCV3135085 | 0.33 | 0.67 | 0.74 | 0.533 | 1.034 | 0.0781 | het | endpt1 |
| hCV3215409 | 0.42 | 0.58 | 1.48 | 0.955 | 2.28 | 0.0797 | hom | endpt1 |
| hCV7494810 | 0.25 | 0.75 | 1.35 | 0.987 | 1.844 | 0.0608 | het | endpt1 |
| hCV783138 | 0.11 | 0.89 | 0.66 | 0.417 | 1.045 | 0.0762 | het | endpt1 |
| hCV795442 | 0.32 | 0.68 | 0.74 | 0.535 | 1.032 | 0.0765 | het | endpt1 |
| hCV818008 | 0.15 | 0.85 | 1.33 | 0.956 | 1.839 | 0.0914 | het | endpt1 |

SEQUENCE LISTING (5416 sequences)

SEQ ID NO: 1 - DNA, 10412 bp, Homo sapiens
gtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccaaaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccagaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacagaaa

SEQ ID NO: 2 - DNA, 4930 bp, Homo sapiens
gataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaaattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtcaaaaatatgaagaataaagacaaacgtttaaagatcatgaatgagattcttagtggaatcaagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggccagtgtttccacagagcggctagagaagtacttgggaggggatgacttggacacatctgccattcgacatgactgcaattttgacaaagccatgcagttttctgaggcctcctttacctgggaacatgattcggaagccacagtccgagatgtgaacctggacattatggcaggccaacttgtggctgtgataggccctgtcggctctgggaaatcctccttgatatcagccatgctgggagaaatggaaaatgtccacgggcacatcaccatcaagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacagtccatgatggcagtgaagaagaagacgatgactatgggctgatatccagtgtggaagagatccccgaagatgcagcctccataaccatgagaagagagaacagctttcgtcgaacacttagccgcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggtgaggattgacaccaaccagaaatgtgtcttttcctggatcacctccaacaggtggcttgcaattcgcctggagctggttgggaacctgactgtcttcttttcagccttgatgatggttatttatagagataccctaagtggggacactgttggctttgttctgtccaatgcactcaatatcacacaaaccctgaactggctggtgaggatgacatcagaaatagagaccaacattgtggctgttgagcgaataactgagtacacaaaagtggaaaatgaggcaccctgggtgactgataagaggcctccgccagattggcccagcaaaggcaagatccagtttaacaactaccaagtgcggtaccgacctgagctggatctggtcctcagagggatcacttgtgacatcggtagcatggagaagattggtgtggtgggcaggacaggagctggaaagtcatccctcacaaactgcctcttcagaatcttagaggctgccggtggtcagattatcattgatggagtagatattgcttccattgggctccacgacctccgagagaagctgaccatcatcccccaggaccccatcctgttctctggaagcctgaggatgaatctcgaccctttcaacaactactcagatgaggagatttggaaggccttggagctggctcacctcaagtcttttgtggccagcctgcaacttgggttatcccacgaagtgacagaggctggtggcaacctgagcataggccagaggcagctgctgtgcctgggcagggctctgcttcggaaatccaagatcctggtcctggatgaggccactgctgcggtggatctagagacagacaacctcattcagacgaccatccaaaacgagttcgcccactgcacagtgatcaccatcgcccacaggctgcacaccatcatggacagtgacaaggtaatggtcctagacaacgggaagattatagagtgcggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaaaataaatgtcaccaggtacttgagaaacccctcgattg

SEQ ID NO: 3 - DNA, 5843 bp, Homo sapiens
gagcggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcatcagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctccattcaga

SEQ ID NO: 4 - DNA, 1567 bp, Homo sapiens
ggtgcgcggggaggtggagggcgaggggcggggctacctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaaaaaaaaaaaaaaaaaa

SEQ ID NO: 5 - DNA, 2109 bp, Homo sapiens
ttgctgcatagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 6 - DNA, 2158 bp, Homo sapiens
cggattgtcagactgctcctccctcttctttagactgccacgaggaaaaagcagatgtgagaactcaaggttcagggctgctcttctaagaaacaagtctgccataatctccatctgtgttggaatctgttaactaatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaaacatgccagtgacagccacacctgtgtgaagacaaaacacaatgagatcatggccatattctttaccagtggaacaagtggatatccgaaaatgactgcacacacccacagcagttttggtttaggattatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaagattgtagatgtaaatggcaatgttctacctcctggacaagaaggagatattggcattcaagttctacccaaccgaccatttggcctttttactcattacgtagataatccttcaaaaacagcttcaactctacgaggcaatttctatatcactggggacagaggatatatggataaagatgggtatttctggtttgttgcaagagcagatgatgtcatattatcctctggctatcgaattggaccatttgaggtagaaaatgccctgaatgaacacccttcagttgcagagtcagctgttgtcagcagcccagaccccatcagaggagaggtagtaaaggcttttgtcgttctaaatcctgattacaagtcacatgatcaagaacaactaataaaggagattcaggagcatgttaaaaaaactacagcaccttacaaatatcccagaaaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctccaaaaaaaaaaaaaaaaaaaaaaaaaa

SEQ ID NO: 7 - DNA, 1587 bp, Homo sapiens
cggattgtcagactgctcctccctcttctttagactgccacgaggaaaaagcagatgtgagaactcaaggttcagggctgctcttctaagaaacaagtctgccataatctccatctgtgttggaatctgttaactaatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaaacatgccagtgacagccacacctgtgtgaagacaaaacacaatgagatcatggccatattctttaccagtggaacaagtggatatccgaaaatgactgcacacacccacagcagttttggtttaggattatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaaggtttgcacatccccttccaggagaatgtttaacaacccaatctgtacactacctacctaccgcttacccccatataaactttctttgttatgatggtgattccattttacttccatgatactttaatttttataaatatgtgaaaatgattagaaatgaaaaaaaaaaaaaaaaaa

SEQ ID NO: 8 - DNA, 4670 bp, Homo sapiens
gcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaaggtccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggcccgtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtcggcggcacgtgcggggtcgtggacgacgagccccggccgactgggaaagcggagaccgaagacgaggacgaagggactgagggcgaggacgaaggggctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaaaaaaaaaaaaaaaaaaaaa

SEQ ID NO: 9 - DNA, 3970 bp, Homo sapiens
gcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaaaaaaaaaaaaaaaaaaaaaaaaaaaaaaa

SEQ ID NO: 10 - DNA, 4063 bp, Homo sapiens
gcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaaaaaaaaaaaaaaaaaaaaaaaaaaaaaaa

SEQ ID NO: 11 - DNA, 4004 bp, Homo sapiens
gcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaaaaaaaaaaaaaaaaaaaaaaaaaaaaaaa

SEQ ID NO: 12 - DNA, 4068 bp, Homo sapiens
gcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaa

SEQ ID NO: 13 - DNA, 2362 bp, Homo sapiens
actataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaaaaaaaa

SEQ ID NO: 14 - DNA, 2336 bp, Homo sapiens
actataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcggatgaagaaaatgaatcacaagtcaactgacagtccaaaggctccacagctcagaggaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaaaaaaaa

SEQ ID NO: 15 - DNA, 2278 bp, Homo sapiens
actataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaaaaaaaa

SEQ ID NO: 16 - DNA, 2420 bp, Homo sapiens
actataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccagatgaagaaaatgaatcacaagtcaactgacagtccaaaggctccacagctcagaggaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaaaaaaaa

SEQ ID NO: 17 - DNA, 2236 bp, Homo sapiens
atgaagaaaatgaatcacaagtcaactgacagtccaaaggctccacagctcagaggagggcatgccattgcaagagaatgctcagccatgttcatctggggacctgctcctggtagagcaataggatctgtgtgcccagcaccactgcccacctagctgtcctggcctgtgcccaatgctgaccttcacctcagagtgtggctgtaccacattcggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaaaaaaaa

SEQ ID NO: 18 - DNA, 5827 bp, Homo sapiens
ccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcctgggttcaagtgattctcttgcctcagcctcccgagttgctgggattacaggcatggtggcgtgagcctgtagtcctagctactcaggaggctgaggcaggagaatagcctgaacctgggaatcggaggttgcagagccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaataaaaaaaaaaaaaaa

SEQ ID NO: 19 - DNA, 3510 bp, Homo sapiens
aaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccctggagacgatggatacagggaagccatttcttcatgcttttttcatcgacctggagggctgtattagaaccctcagatactttgcagggtgggcagacaaaatccagggcaagaccatccccacagatgacaacgtcgtgtgcttcaccaggcatgagcccattggtgtctgtggggccatcactccatggaacttccccctgctgatgctggtgtggaagctggcacccgccctctgctgtgggaacaccatggtcctgaagcctgcggagcagacacctctcaccgccctttatctcggctctctgatcaaagaggccgggttccctccaggagtggtgaacattgtgccaggattcgggcccacagtgggagcagcaatttcttctcaccctcagatcaacaagatcgccttcaccggctccacagaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaaaaaaaaaaaaaaaa

SEQ ID NO: 20 - DNA, 6222 bp, Homo sapiens
gggggcggcagcggtggtagcagctggtacctcccgccgcctctgttcggagggtcgcggggcaccgaggtgctttccggccgccctctggtcggccacccaaagccgcgggcgctgatgatgggtgaggagggggcggcaagatttcgggcgcccctgccctgaacgccctcagctgctgccgccggggccgctccagtgcctgcgaactctgaggagccgaggcgccggtgagagcaaggacgctgcaaacttgcgcagcgcgggggctgggattcacgcccagaagttcagcaggcagacagtccgaagccttcccgcagcggagagatagcttgagggtgcgcaagacggcagcctccgccctcggttcccgcccagaccgggcagaagagcttggaggagccaaaaggaacgcaaaaggcggccaggacagcgtgcagcagctgggagccgccgttctcagccttaaaagttgcagagattggaggctgccccgagaggggacagaccccagctccgactgcggggggcaggagaggacggtacccaactgccacctcccttcaaccatagtagttcctctgtaccgagcgcagcgagctacagacgggggcgcggcactcggcgcggagagcgggaggctcaaggtcccagccagtgagcccagtgtgcttgagtgtctctggactcgcccctgagcttccaggtctgtttcatttagactcctgctcgcctccgtgcagttgggggaaagcaagagacttgcgcgcacgcacagtcctctggagatcaggtggaaggagccgctgggtaccaaggactgttcagagcctcttcccatctcggggagagcgaagggtgaggctgggcccggagagcagtgtaaacggcctcctccggcgggatgggagccatcgggctcctgtggctcctgccgctgctgctttccacggcagctgtgggctccgggatggggaccggccagcgcgcgggctccccagctgcggggccgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccttctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcaatggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggtggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttctttcaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaaaa

SEQ ID NO: 21 - DNA, 2358 bp, Homo sapiens
cccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggcccgcgcggggcgaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccgcccgcctgccaggagacaatgctttggacatgttccagaagcatcgagagaaggaactgaaagacagacagcagatctactgctgggccacctggaaggaagggttacccctgaccatcgctgcagaccgtaaggatgatctacctccaaatatgagattccatgaggagaagaggctggactttgaatggacactgaaggcaggggctctggagatggccctcaaacgtgtttacaccctcctgagctcctggaactgcctagaagactttgatcagatcttctggggccagaagagtgccctggctgagaaggttcgccagtgctggcaggatgatgagttgttcagctaccagttcctcaatggtgccaaccccatgctgttgagacgctcgacctctctgccctccaggctagtgctgccctcggggatggaagagcttcaggctcaactggagaaagaacttcagaatggttccctgtttgaagctgacttcatccttctggatggaattccagccaacgtgatccgaggagagaagcaatacctggctgcccccctcgttatgctgaagatggagcccaatgggaagctgcagcccatggtcatccagattcagcctcccaaccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaagttcctgatcccccatatccgctacaccatggaaatcaacacccgggcccggacccaactcatctcagatggaggaatttttgataaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtatgtggaggggatcgtccacctcttctaccaaagggatgacatagtgaagggggaccctgagctgcaggcctggtgtcgggagatcacggaggtggggctgtgccaggcccaggaccgaggtttccctgtctccttccagtcccagagtcaactctgccatttcctcaccatgtgcgtcttcacgtgcactgcccagcatgccgccatcaaccagggccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactga

SEQ ID NO: 22 - DNA, 3740 bp, Homo sapiens
gggacggcggcggcgcagctcggaacccgccagggtccagggtccaggttccagcgcccggcggcccaggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccgggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggcccccatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23 - DNA, 1460 bp, Homo sapiens
tgcagcgcaggtgagctctcctgaggacctctctgtcagctcccctgattgtagggaggatccagtgtggcaagaaactcctccagcccagcaagcagctcaggatgttcctgaaggccgtggtcctgaccctggccctggtggctgtcgccggagccagggctgaggtcagtgctgaccaggtggccacggtgatgtgggactacttcagccagctgagcaacaatgccaaggaggccgtggaacatctccagaaatctgaactcacccagcaactcaatgccctcttccaggacaaacttggagaagtgaacacttacgcaggtgacctgcagaagaagctggtgccctttgccaccgagctgcatgaacgcctggccaaggactcggagaaactgaaggaggagattgggaaggagctggaggagctgagggcccggctgctgccccatgccaatgaggtgagccagaagatcggggacaacctgcgagagcttcagcagcgcctggagccctacgcggaccagctgcgcacccaggtcagcacgcaggccgagcagctgcggcgccagctgaccccctacgcacagcgcatggagagagtgctgcgggagaacgccgacagcctgcaggcctcgctgaggccccacgccgacgagctcaaggccaagatcgaccagaacgtggaggagctcaagggacgccttacgccctacgctgacgaattcaaagtcaagattgaccagaccgtggaggagctgcgccgcagcctggctccctatgctcaggacacgcaggagaagctcaaccaccagcttgagggcctgaccttccagatgaagaagaacgccgaggagctcaaggccaggatctcggccagtgccgaggagctgcggcagaggctggcgcccttggccgaggacgtgcgtggcaacctgaggggcaacaccgaggggctgcagaagtcactggcagagctgggtgggcacctggaccagcaggtggaggagttccgacgccgggtggagccctacggggaaaacttcaacaaagccctggtgcagcagatggaacagctcaggcagaaactgggcccccatgcgggggacgtggaaggccacttgagcttcctggagaaggacctgagggacaaggtcaactccttcttcagcaccttcaaggagaaagagagccaggacaagactctctccctccctgagctggagcaacagcaggaacagcagcaggagcagcagcaggagcaggtgcagatgctggcccctttggagagctgagctgcccctggtgcactggccccaccctcgtggacacctgccctgccctgccacctgtctgtctgtctgtcccaaagaagttctggtatgaacttgaggacacatgtccagtgggaggtgagaccacctctcaatattcaataaagctgctgagaatctagcctc

SEQ ID NO: 24 - DNA, 14121 bp, Homo sapiens
attcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgacgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagaccctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccagatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaacaaccacaaaagcccaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcata

SEQ ID NO: 25 - DNA, 1223 bp, Homo sapiens
gggatccttgagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcaaaaaaaaaaaaaaaaaaaaaaaaaaaaaaaaaaaaaaaaaaaa

SEQ ID NO: 26 - DNA, 1216 bp, Homo sapiens
ggctctgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacacaaaatgtcacacttgtttcttgttcatccaaggaacctaattgaaatttaaaaataaagctactgaatttattgccgcacccaaaaaaaaaaaaaaaa

SEQ ID NO: 27 - DNA, 1794 bp, Homo sapiens
agacagagggagcagtgaatagcaatagggtgtttccaccatggtcttcactcaggccccggctgaaatcatgggccacctccggatacgcagcctcctggcccggcagtgcctggcagagtttctgggtgtgtttgtactcatgctcctcacccaaggagctgtggcccaggctgtcaccagtggagaaaccaaaggcaacttcttcaccatgtttctggctggctctctggccgttacgatagccatctacgtgggtggtaacgtctcaggggcccacctgaatccagccttctccctggccatgtgcatcgttggacgcctcccctgggtcaagctccccatttacatcttggtgcagttgctgtctgctttctgtgcttcgggagccacctatgttctctaccatgatgccctacagaactatacaggtgggaacctgacagtgactggccccaaggagacagcctccatttttgccacctatcctgccccctatctgtccctgaacaatggcttcctggatcaggttctgggcactgggatgctgattgtggggctcttggccatcctggacagacggaacaagggagtccctgcgggtctggagcctgtggtggtggggatgctgatcctggccctcgggttatccatgggtgccaactgcgggattccactcaaccctgcccgggacctgggcccacgtctcttcacctacgtggctggctggggtcctgaagtcttcagtgctggtaatggctggtggtgggtgcctgtggtggcccctctggtgggggccaccgttggcacagccacttaccagctgttggtggctctgcaccaccctgagggcccagagccagctcaggatctggtgtctgctcaacacaaagcctcagagttggaaactcctgcctcagctcagatgctggagtgtaagctatgattaggacaaccctcacttcactcatggaccctggagccagccactgaccccgcctgggaacaacagtcattcttcctctttgttaatgtgccagaacctgggaggcttctctgtttatctgtttggcatcccttcctcctaaactaagaaggatcctggacagggagaagtggaggaggataaggtaccaggactcaggcttctcatcccctcctcccgcaaagcggttttctgaccctcagggcctctcggaatgtagttgctcgaggtaaccgctagagggtgcgcacctggatgctggatggggacggctgcgggcatctgcagggtggagggggccaccatccagtgtagggcacaaccctggggactgccctccatagcctgtcccgactgccgactcctagctctcatcgcctcggcgcctcccaccttcaccctctcggggatgcctccccaagagggtagttaggggtggggaagccgcctccacccagggggcgtggtgggggcggagggaaggagggcggcggggcacagagacagagagcaaggctgtgaaactgaggcaccgttcctagacatctcggtgctgtgtcgttcattcaaggagagttgagatacagtgaaatgagccagggcgaggagggagggtgaaggaacggagggcgggcggctccgaggagcgagagtcgggctgagggcaacctggcgccagggaaaattctggttattcaccacttctacagctctcctgccgctccctgcagaggatgctcgttttgcagagaaggcagtgttcctctattcccttcttccgaattaaaaataccccctcagagcgaaaa

SEQ ID NO: 28 - DNA, 2488 bp, Homo sapiens
ttttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaacctcagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcagttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagcta

SEQ ID NO: 29 - DNA, 1594 bp, Homo sapiens
ggctaacctgttgtaagcccgcagctttgggcctggtctctgctgctcccaggcggcccctttgggtactgcctgagcaagaagtgctggagaggaggaccagtcatcaataggaggatgagattgggagagacactcggtgcaggaggctgagtgagcaggggagcactaagacccaggggtagtggaggactgcagcaacgagctggaggaggagaagtaagcggtggggggtgggagccatctggtactttgacagcattcaaaacagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaa

SEQ ID NO: 30 - DNA, 1440 bp, Homo sapiens
ggctaacctgttgtaagcccgcagctttgggcctggtctctgctgctcccaggcggcccctttgggtactgcctgagcaagaagtgctggagaggaggaccagtcatcaataggaggatgagattgggagagacactcggtgcaggaggctgagtgagcaggggagcactaagacccaggggtagtggaggactgcagcaacgagctggaggaggagaaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaa

SEQ ID NO: 31 - DNA, 2678 bp, Homo sapiens
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaa

SEQ ID NO: 32 - DNA, 2513 bp, Homo sapiens
ggggcggagctggagggggtggttcggcgtgggggccgttggctccagacaaataaacatggagtccatcttccacgagaaacagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaa

SEQ ID NO: 33 - DNA, 1949 bp, Homo sapiens
atgacgcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgc

SEQ ID NO: 34 - DNA, 4523 bp, Homo sapiens
atgagaccccggggagcagcgtttgcagcgggcccgccaggtgacctgcacctgggcaccgccatcggcttcgcaggggccatctggaggagtcggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgggcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctcagt

SEQ ID NO: 35 - DNA, 2133 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccatggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 36 - DNA, 2003 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccatggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 37 - DNA, 2082 bp, Homo sapiens
agattgctgcctatgcaaagcaggtaagaagccgaactctgaggcctctcgccattgtctccgagtcggccagctggagcgttttcggggctgtaaagggagaatggcgcatgcgcatattcagggcggaaggcgcgctaagagcagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccaaaaaaaaaaaaaaaaaa

SEQ ID NO: 38 - DNA, 3144 bp, Homo sapiens
ggtgacaaagctaatcgaggtggcaattggggaaggggttctgggctgccgcaggcacacaggccagagcttcgtggatacctgcagggcccaaaggtccctccctgttttgaagagtgagtgatggctatgaggtagcggccaggctgatcacccctgcgttggctggaggcagaattctgtaaatcctcgccaagtctttctccaggccactggttagctcatctcagcctcctctgggagcatcaacaccaacatggcacaggggactgcagtggtgtgctttggacctgtgtacccacccaaggctaaaggcagagccagatggagaaggaaaggcaagtgacttgtccagagccactctgtcaaaaggggacttgagtcctcagggctgttgactccaaagctgacaagcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaattgtgtactcttcggaatatcgtgatgaaatctcacaccatcctgctccatcctacctaggacgtgaatcctccctttgtccagggtacccgtgctgtctacaccacccgcctgccagtcacccagcaggtgatcagatcgactgtcatggtattgcagtgcttatattcaagaacctcttatgtgactcagtaatgtcctcaaagtgcaagagcagagatgctggcaatttggatatgccaaaaagaggccataaagggcttcctttaagtg

SEQ ID NO: 39 - DNA, 2260 bp, Homo sapiens
gtcgctcaccagtccgcagctcgtgcttgacagtgaggagctgctctcctccgtcgccgccgtccgcgctggtccccgcggcgccgccgctgctgccaccctcctcctccatcttctcctttttttccgatcccgcgggtcgctacgaggggaacccaggagacagcggacgcccgtcccctcgcagccgctgccgcggccccaggagtcggggtgcggcggctccagaactcggacgcaaagacgagtctctttcccgctctggccgcacggctcgctcctcgcctcctcccccttcggcgggcaccgctagtaccgcgcaaccaaaccgccccctgctccaccgccgcctcctcaggccgctccgcccacagccagcaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgagcactcggatggccgcccagtccggccggctacccagggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggtaacaaaccccagccagccgctcgcctggaagcagcttttaccctggatgagcagcaggcctgaggtcccaagccgtaagccgagggctggcaccctgctgcccctcaaaagccagaggcagagccagcct

SEQ ID NO: 40 - DNA, 2990 bp, Homo sapiens
gctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaatggagaaggaaaggcaagtgacttgtccagagccactctgtcaaaaggggacttgagtcctcagggctgttgactccaaagctgacaagcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaattgtgtactcttcggaatatcgtgatgaaatctcacaccatcctgctccatcctacctaggacgtgaatcctccctttgtccagggtacccgtgctgtctacaccacccgcctgccagtcacccagcaggtgatcagatcgactgtcatggtattgcagtgcttatattcaagaacctcttatgtgactcagtaatgtcctcaaagtgcaagagcagagatgctggcaatttggatatgccaaaaagaggccataaagggcttcctttaagtg

SEQ ID NO: 41 - DNA, 6688 bp, Homo sapiens
atggcatgctgtcacaaagtaatgctgctgctggacaccgcgggcggcgccgcccgccacagccgggtccggcgggccgccctgcgcctcctcacctatctgagttgccgattcggcctggccagggtccactgggccttcaagttctttgactcgcagggggcgcggagccggccgtcccgcgtgtctgacttccgcgagctggggtcccgctcgtgggaggactttgaggaggagctggaggccaggctcgaggatcgcgcccacctgcccggcccggcgcccagggccacccacacgcacggcgccctgatggagacgctgctagactaccagtgggaccggcccgagatcacgtcgcccacgaagccgatcctgcggagcagcgggaggagactgctggacgtggagagcgaggccaaggaggccgaggccgcgctcgggggcttggtgaacgccgtcttcctcctggccccctgtccgcactcgcagagggagctgctgcagttcgtgtctgggtgcgaggcccaggcccagcgcctgccgcccacccctaagcaggtgatggagaagttgttgcccaagagagtccgggaagtcatggtcgcccgaaaaatcaccttctactgggtggataccaccgaatggtctaagttgtgggaatccccagaccaccttggatactggactgtttgtgaactgctccaccacggaggtggcactgtcttgccatctgaatctttcagctgggattttgctcaagctggggaaatgctgctcaggagtggaataaagctgtcaagtgaacctcatctttctccgtggatttcaatgctgccaactgatgccactttaaaccgtttgctctacaattctcctgagtatgaggcctcgtttccacgaatggaaggaatgttatttctccctgttgaagcaggcaaagagattcaagaaacatggacagtcaccctagagcccttggccatgcatcagagacattttcagaaaccagtcagaatttttctaaaaggctcagtggcccagtggtctctcccaacgagcagcactttgggcactgacagctggatgctaggaagtccagaggagagcacagcaactcaaaggctgttatttcagcagttggtaagcaggctgactgctgaagagttacacctggttgctgatgtggaccctggtgaaggccggccccccatcactggagttatttccccactctctgccagtgctatgatcctcactgtgtgccgcaccaaggaggctgaatttcaacgacatgttctccaaacagctgtggctgacagcccccgggacacagcttcccttttctcagatgttgtggatagtatattgaatcagactcatgattcgcttgcagatactgcttctgctgcttctcctgttccagagtgggcccagcaggagcttggccacaccactccctggagtccagctgttgtggaaaagtggtttcctttctgtaacatcagtggtgccagttccgatttgatggagtcatttgggttactacaggctgcctcagctaataaggaagagtcttccaaaactgaaggcgaattaatacattgccttgccgagctctaccagagaaaatctcgtgaagaatccactatagctcatcaagaagacagcaaaaagaaacgaggggtccctcgtactccagtgagacagaagatgaataccatgtgccgttccttaaagatgttgaatgtcgcaaggctgaatgtgaaggcccagaagttacatccagatggcagtccggatgtggctggggagaaaggaatccaaaagatacctagtgggagaacagtggataaattggaagacagaggaagaacactaagaagttctaaacctaaagattttaaaactgaggaagagctgctatcatatatacgtgaaaattaccaaaagactgtggccacaggagaaatcatgttgtatgcatgtgctcgaaacatgatctcaaccgttaaaatgttcctaaaatcaaaaggcaccaaggaattagaagtgaactgcctgaatcaagtaaaaagtagtctcttaaaaactagtaaaagtcttcgacagaatctaggaaaaaaactggataaggaagacaaagttagagagtgccagcttcaggtatttcttcgtttggagatgtgtctgcaatgcccttcaataaatgaaagtacagatgatatggaacaagtagtggaggaggtgacagatttgctgcgcatggtgtgtttaactgaggattcagcgtacctagcagagtttctggaggaaattttgagattgtatattgactctatcccaaagacacttggaaatctttacaacagcctagggtttgtgattcctcagaagctggctggtgtccttcctacagattttttcagtgatgactccatgacacaagagaacaaatcaccacttctttctgtgccttttttgtcaagtgctcgtagatcagtgtcaggcagccctgaatctgatgaactgcaggaacttcgtaccagatcagccaagaagagaaggaaaaatgcattaataagacataaaagcattgctgaggtttcacagaatcttcgacaaattgaaattcctaaagtgtcaaagagagctacgaaaaaagagaactctcaccctgctcctcagcagccttcccagccagtgaaagatacagtgcaagaagtgaccaaagttcgaagaaatcttttcaaccaggaattgctttccccttcaaagagatcactaaagcgggggttgcctagaagccattctgtgtcagctgtggatggtctagaggataaacttgacaacttcaagaagaacaaaggttatcacaaactgctgactaagagtgtggccgagactccagtgcataagcagatctccaaaaggctgctgcacagacaaatcaagggcaggtcctctgatcctggtcctgatattggtgttgttgaagagtcccctgaaaaaggagatgaaataagtctgagacgaagtcctcgaatcaagcagttgtcatttagcaggacacattctgcctccttctattctgtgtctcagccgaagtctcgaagtgtgcaaagagtccactctttccagcaagataagtcagaccaaagagaaaattctccagtccaaagtattcggtctcccaagagtcttctttttggggcaatgtctgagatgatcagcccctcagaaaagggttcagctcgaatgaaaaagcgttcaagaaacactttggattcggaggtacctgcagcttaccagactcccaagaagagtcaccagaaatctctgagcttttctaaaactacaccaagaaggatctctcatacaccacaaactccgttgtatactccagaaaggctgcagaagtcccctgcaaaaatgacccctacaaagcaggcagcttttaaggagtccttaaaagactcctcctcacccggccatgactcaccattggattcaaaaatcactcctcaaaaacgacatacccaggcaggagaaggtacctctcttgaaacgaagacaccaagaactcctaagaggcaaggtactcagccgcctgggtttttgccaaactgtacttggccacattcagtgaattccagtccagaaagcccctcctgtccagcccctccaacttcatcgactgcccagcccaggagagagtgtctcactcccatcagagaccctctcagaacacctccgagagcagcagccttcatgggcacgcctcagaatcaaacacaccaacagccccatgtcctcagagctgctcgggcagaggaaccagcccagaaactaaaggataaagctatcaaaactccaaaaagaccagggaattcaactgtgacttcttccccacctgttacgccaaagaaactgtttacctctcctttatgtgatgtctccaagaagagtccatttaggaaatctaaaatagagtgtccttccccaggagaactggatcagaaagagccccagatgtcacccagcgtagctgcatctctctcctgccctgttccctcaactccccctgaactctcacagagagctacattggacaccgtccctcctccacccccttctaaagttgggaaacggtgtagaaagacctctgatcccagaaggagcatcgtggagtgtcagcctgatgcctccgctactcctggggttggcacagctgacagcccagctgcccccacagactctagagatgaccagaagggactgagcctctctcctcagtctcctcctgaaagacggggctacccaggccctggtctcaggagtgattggcatgcatcctctcctctgctcattacaagtgacacagagcatgtcactctcctcagtgaagccgaacaccatggcattggtgacttgaaaagtaacgtcttatcagtggaagagggtgaggggctaaggacagcagatgctgagaagtcttctctgtctcaccctgggattcccccatctcctccttcctgtgggcctggctctcctctgatgccttcccgtgacgtgcactgtaccacagatgggagacagtgccaggcttcggcacaactagacaacctgccagcatcagcttggcattccacagactctgccagcccacagacctatgaggttgagctggagatgcaagcttctggccttcccaaacttcgaattaagaagatagaccccagctcttcattagaggctgagcccctcagcaaggaggagagctctctgggagaagagagcttcctccctgctctcagcatgcccagggccagcaggtccttaagcaaacctgaacccacctatgtgtcacccccctgcccccgcctctcccacagcacacctggcaagagcagggggcaaacctacatctgccaggcctgtacccccacccacggcccttctagtaccccctctccatttcaaacagatggggttccttggacaccatcccccaagcacagtgggaagacaactccagacataattaaagactggcccaggaggaagagggcggtgggctgtggcgccggctcctcttccgggaggggcgaggtcggtgcagaccttcctgggagcctgtcactgcttgagtcagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagtgcatggcagctaccctccacgggagacgaagaggtgtttgtttccggctccaccccacctcccagctgtgccgtgcggagctgcctctctgccagtgccctccaggctctgacccagtctccgctgctgttccaggggaaaacaccttcctctcagagcaaagaccccagagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatggtcagtgttcagattgccattagaatgccttagggttttctaattccccttatggatccaatccatctcctggccctgccccttgttggggaagttgcaggaggagaggtggatggcaatgtgattggtgctataactcaggcagcctgggagtcaggaacccagacaaggaatcccattccagcctcaccccaaccatgaccttggcaagtcagggggccactctgcctcatttatgcaaatggagaaaggcgccctccctggggtcccttgagctgctgtaaggctgggctgctgcgacacaggcagcgctttgtaaactgtgaagccatatacgtgaaactgaagagtgcattgggcagtggaagctattttttgccttccctgtgtaacagtaaaatcatctctagtgactgagcactcagtacatttttgtttaatgttgggcctgaggttaactgtgaccatggtccagcttgagtggcttctggagcagccacattttcaaggactgtccaagagccagccagttcagggctcaggcctcacccattgcccactcctggggagaccatcacctggctcatcgtttccaccaagagtgccccacaggagtgccccacagacccgctggaccagcctgctgcgggtcctggccaggggtctggctaacggtgagggctgactctgaactgtctctcagtctccagaaagtgttcaagcctgttgtgttcccaaatctgattcctcctattgtcttgtaaatcaaactctaagtgaaaacttcccatttgtcccttcaaagatttttttttattaaatggttttttaagatcctaaaaaaaaaaaaaaaaaaaaa

SEQ ID NO: 42 - DNA, 2173 bp, Homo sapiens
ccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagcctttgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaa

SEQ ID NO: 43 - DNA, 2239 bp, Homo sapiens
ccggttccggggacgggcaacagggactcagggaccagaaggcggctgcaggacgcgaccgagcaggaccccaggcccgggaacgacgtcgcgagcgctgagactgccgggcctcccagcccatctggcattcgagcgcaggaccgggcgccccggcaccgccgcgcgccacccgctaggatgccggtggccccagcgccctcagccgacggaggagccctttttcaacgccctcgctggagtctggcctgcacgccttgctgaatgaagccggaacctcagccccgcttccctttgaaatgaatgttcctggggcgccctctcgtggattttggagctaatcgtctgtgaatgccaagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttcacgctgggcgccctgcccattctgggctggaactgcctgcacaatctccctgactgctctaccatcctgcccctctactccaagaagtacattgccttctgcatcagcatcttcacggccatcctggtgaccatcgtgatcctctacgcacgcatctacttcctggtgaagtccagcagccgtaaggtggccaaccacaacaactcggagcggtccatggcactgctgcggaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagccccctcatcctgcatcatggacaagaacgcagcacttcagaatgggatcttctgcaactgatcgtctccatgcgccctgctctgcggctgtgttcttatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatg

SEQ ID NO: 44 - DNA, 2626 bp, Homo sapiens
aatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttagcgccatcagggcagtggccaagaacaccacccccggggcagccctgcctgcgggggagtgggggaccgtgcagctacggggttcttggagagtcggccagacggcggggggcagcaggaactttgcctcataccccaccaacccctgcttccccttctcggtccccgagggccctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggccatccattcacagccaggagatgctgggccagttcctccaagaggtctccgtcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgc

SEQ ID NO: 45 - DNA, 4145 bp, Homo sapiens
gggtggcctggtgtgtgggcgcggcagggcgcaggcgcaggcgcagtgtgcgtccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccgttgagctgtgactacgacttgagtctcccttttccggtgtgtgagtcctgtcccctttacaagaagctccgcctgtcgacagatactgtggaacactccctagacaataaagatggtcctgtctgccttcaggtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgttctttaagactttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattaaaaaaaaaaaaaaaaaaa

SEQ ID NO: 46 - DNA, 3927 bp, Homo sapiens
gggtggcctggtgtgtgggcgcggcagggcgcaggcgcaggcgcagtgtgcgtccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgttctttaagactttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattaaaaaaaaaaaaaaaaaaa

SEQ ID NO: 47 - DNA, 4913 bp, Homo sapiens
caacaggcacctggctgcagccaggaaggaccgcacgccctttcgcgcaggagagtggaaggagggagctgtttgccagcaccgaggtcttgcggcacaggcaacgcttgacctgagtcttgcagaatgaaaggcatcacaggaggcctctgcatgatgtggcttccaaagactcaaggaccacccacattacaagtctggattgaggaaggcagaaatggagattcaaacaccacgtcttctattattttattaatcaatctgtagacatgtgtccccactgcagggagtgaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggaggtgcccttctccaactgcagccgagactgcctggcagggaccaggaaagggatcattgagggggagcccacctgctgctttgagtgtgtggagtgtcctgatggggagtatagtgatgagacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccctcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccctcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacaccagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataaaatggaaggagaagactgggctagggagaatgcagagaggtttcttggggtcccagggatgaggaatcgccccagactcctttcctctgaggaagaagggataatagacacatcaaatgccccgaatttagtcacaccatcttaaatgacagtgaattgacccatgttccctttaaaattaaaaaaaagaagagccttgtgtttctgtggttgcatttgtcaaagcattgagatctccacggtcagatttgctgttcacccacatctaatgtctcttcctctgttctatcccacccaacagctcagagatgaaactatggctttaaactaccctccagagtgtgcagactgatgggacatcaaatttgccaccactagagctgagagtctgaaagacagaatgtcaccagtcctgcccaatgccttgacaacagactgaattttaaatgttcacaacataaggagaatgtatctcctcctatttatgaaaaccatatgatattttgtctcctacctgctgctgctattatgtaacatccagaaggtttgcacccctcctataccatatgtctgcttctgtccaggacatgatactgatgccatgtttagattccaggatcacaagaatcacctcaaattgttaggaagggactgcataaaccaatgagctgtatctgtaattaatattcctatatgtagctttatccttaggaaaatgcttctgttgtaatagtccatggacaatataaactgaaaaatgtcagtctggtttatataaggcagtattattgagctctatttccccaccccactatcctcactcccataagctaagccttatgtgagccccttcagggactcaagggtccagaagtccctcccatctctaccccaaagaattcctgaagccagatccaccctatccctgtacagagtaagttctcaattattggcctgctaatagctgctagggtaggaaagcgtggttccaagaaagatccaccctcaaatgtcagagctatgttccctccagcagtggtattaatactgccggtcacccaggctctggagccagagagacagaccggggttcaagccatggcttcgtcatttgcaagctgagtgactgtaggcagggaaccttaacctctctaagccacagcttcttcatctttaaaataaggataataatcattccttcccctcagagctcttatgtggattaaacgagataatgtatataaagtactttagcctggtacctagcacacaataagcattcaataaatattagttaatattat

SEQ ID NO: 48 - DNA, 2120 bp, Homo sapiens
cgggaacccaggcggggcgagccgcgggagagtggagggcaggcgcctgggctgggggcggggaccaggcggggcagggggcagggagaggagggcggcgggagcctgagccggaatcgcagcgtgagcaggtggagccgcggtgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatagaaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgactctgggatgctcctagtttgacctcacagtgacccttcccaatcagcactgaaaataccatcaggcctaatctcatacctctgaccaacaggctgttctgcactgaaaaggttcttcatccctttccagttaaggaccgtggccctgccctctccttccttacccaaactgttcaagaaataataaattgtttggcttcctcctga

SEQ ID NO: 49 - DNA, 360 bp, Homo sapiens
atggcaggcctgatgaccatagtaaccagccttctgttccttggtgtctgtgcccaccacatcatccctacgggctctgtggtcatcccctctccctgctgcatgttctttgtttccaagagaattcctgagaaccgagtggtcagctaccagctgtccagcaggagcacatgcctcaaggcaggagtgatcttcaccaccaagaagggccagcagttctgtggcgaccccaagcaggagtgggtccagaggtacatgaagaacctggacgccaagcagaagaaggcttcccctagggccagggcagtggctgtcaagggccctgtccagagatatcctggcaaccaaaccacctgctaa

SEQ ID NO: 50 - DNA, 1745 bp, Homo sapiens
gaggaggaaacaacttcccggttgctttcagacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtgggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctaaaaaaaaaaaaaaaaa

SEQ ID NO: 51 - DNA, 4231 bp, Homo sapiens
atatgtagccttttcattttcatgaaagtgaagtgatttttagaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaatgggcttcctaattttttgtagagtttcctagatgtattataatgtgttttatttgacagtgtttcaatttgcatatacagtactgtatattttttcttatttggtttgaataattttcctattaccaaataaaaataaatttatttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgagggcacaaaaaaaaaaaaaaaaaaaaaaaaaaaaaaaaaaaaaaaaa

SEQ ID NO: 52 - DNA, 4148 bp, Homo sapiens
atatgtagccttttcattttcatgaaagtgaagtgatttttagaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaatgggcttcctaattttttgtagagtttcctagatgtattataatgtgttttatttgacagtgtttcaatttgcatatacagtactgtatattttttcttatttggtttgaataattttcctattaccaaataaaaataaatttatttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgagggcacaaaaaaaaaaaaaaaaaaaaaaaaaaaaaaaaaaaaaaaaa

SEQ ID NO: 53 - DNA, 3287 bp, Homo sapiens
tccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaagacccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 54 - DNA, 2748 bp, Homo sapiens
tccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaagacccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaaatggacacactggtgtggattaacctgccagggagacagagctcacaataaaaatggctcagatgccacttcaaag

SEQ ID NO: 55 - DNA, 2333 bp, Homo sapiens
ggactgcgttgggtgcagtggttcccgcctgtaaccccagcactttgggaggctgagatcggaggatcgtttgagcccaggagtttgagaccagcctgggtaacatggcaagaccctgtctctacaaaatgtttaaaaaactagctaggtgtggtggcttacacctgtaatcccagcactttgggaggccaaggcgggaggatcacttgaggtcaggagttcaagaccagcctggccaacatggcgaaaccctgtctctactagaaatacagaaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtcccccaggctcctgcacgggctctgttcttttgcagaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaagacccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaaatggacacactggtgtggattaacctgccagggagacagagctcacaataaaaatggctcagatgccacttcaaag

SEQ ID NO: 56 - DNA, 3759 bp, Homo sapiens
tccttttgctctcagatgctgccagggtccctgaagagggaagacacgcggaaacaggcttgcacccagacacgacaccatgcatctcctcggcccctggctcctgctcctgggtaaggactgtggcctgggctagtactggggttctgggatgtcagtgggcactggaggaggaggaaagacccaggcagagaggcgtcaacatagggtagggtgggggcagcggtgtgtatagataaatgtacatacaaatatatatgtttcccatatatacatacacttctctcattgcatcctgctgtctttgtgtatctctgtatttctcccactatcttcagagggaattctttagtctttagaaagctctctgctgggtgcagtggctcatgcctgaaatctcagcactttgtgaggctgaggtgggaggatcacttgaggtcaggagttcaaggccagcttggacaacatagcaagacccctatctctaaaaagaataaaaaattaaacaaattttaaaataaaaaataacttttaaaagaaggctctcatgcccccttagtaatgctttctgatcactgtggtgagttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaagacccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 57 - DNA, 5748 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 58 - DNA, 5619 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 59 - DNA, 3248 bp, Homo sapiens
catgcgtgtcggagaggagagagcagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcatgcccggccgcgggcctatccaccgggaccaggtgaactgctcgggggccgaagcttacctgtgggactgcccggggctgccaggacagcactactgcggccacaaagaggacgcgggcgtggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcgggggaggattactgcaatagtcccaaaagcaagctgcctccatggaacccccaggtgttttcttcagagaggagttccttcctggagcagcccccaaacttggagctggccagcacccagccagccttttcagcagggcccccggctgatgacagctccagcacctcatccggggagtggtaccagaacttccagccaccaccccagcccccttcggaggagcagtttggctgtccagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatgaaaaaaaaaaaaaaaaaaaaa

SEQ ID NO: 60 - DNA, 1790 bp, Homo sapiens
taattacaaaaactaatgactaagagagaggtggctagagctgaggcccctgagtcaggctgtgggtgggatcatctccagtacaggaagtgagactttcatttcctcctttccaagagagggctgagggagcagggttgagcaactggtgcagacagcctagctggactttgggtgaggcggttcagccatgaggctggctgtgcttttctcgggggccctgctggggctactggcagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactaagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtcaaaaaaaaaaaaaaaaa

SEQ ID NO: 61 - DNA, 1872 bp, Homo sapiens
ttaattacaaaaactaatgactaagagagaggtggctagagctgaggcccctgagtcaggctgtgggtgggatcatctccagtacaggaagtgagactttcatttcctcctttccaagagagggctgagggagcagggttgagcaactggtgcagacagcctagctggactttgggtgaggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactaagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtcaaaaaaaaaaaaaaaaa

SEQ ID NO: 62 - DNA, 3539 bp, Homo sapiens
ccggaaccggccttggaacaactgtggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttagtagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattaaaaaaaaaaaaaaaa

SEQ ID NO: 63 - DNA, 2904 bp, Homo sapiens
ggaaactggcggtggccgcggccgccgagtcggtctgcgcatcctcctgcgttttctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctcccaaaa

SEQ ID NO: 64 - DNA, 1766 bp, Homo sapiens
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagatgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccagtggttaatgtggatggttatgactactcatggaaaaagaatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaactagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcaaattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaagtttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgcctttagaaataca

SEQ ID NO: 65 - DNA, 1603 bp, Homo sapiens
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagatgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccataatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaactagtaaaaataccaggtatacacatggccatggctcagaaaccttatacctagctcctggaggtggggacgattggatctatgatttgggcatcaaatattccgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcaaattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaagtttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgcctttagaaataca

SEQ ID NO: 66 - DNA, 2546 bp, Homo sapiens
gctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggggattataagtcaaggaccaagttcagatacttgagacaaagtggaaagtctcagcatatggaaacaaggccttggaggagaccatggacatcaccaagttcatgtgctgggctggaaagaaaagcctgttgattttcacttgctgtgcatttattcatccattccattgcctcaatgctgagaacagtgcctgacacataaaagatgctcaataaatatgttaaaagtaaaaaaaaaaaaaaaaaaaaaaaaaaaaaaaaaaaa

SEQ ID NO: 67 - DNA, 2941 bp, Homo sapiens
ctccaccgccgccgccgccgccgccgctgccgctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgtttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctgg

SEQ ID NO: 68 - DNA, 4100 bp, Homo sapiens
gtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtaatcccaacactttgggaggctgaagtaggaggatcgtcttgagcccaggagttcaagaccagcctggacaacatagtgagaccttgtctccacaaaaataaaaaagaaactatccaggagtggtggtgtgtgcctgtggtccctgctatgcagatgtctaagacaggaggatcacaagagcccaggaggttgagaatgcagtgagcttgtaattgcaccactgcactccagcctgggtgacagagcaagaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcactctgttgcccaggctggagtgcagtggcaccatctcagttcactgcaacttctgcctcccgagttcaagcgattctcctgcctcagcctcccgagtagctggaattataggcgtgcaccaccacgcccagctaatttttgtatttttagtaaagacagggttttgccacattagccaggctggtctcaaactcctgacctcaggtgatccacccaccccagcctcccaaagtgctaagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttctcttgctaatctctcttttgttatagagatctcagccctaaacctaggatggatagaaggaaacatatgttctcccctacattagtaaaaataaaaatggaattttttacccatacaaa

SEQ ID NO: 69 - DNA, 11933 bp, Homo sapiens
atgctcagttggttggagtggcctcactcttacctgccaacctgggaggttgatgatgaacatgtctttaccttttctttggagtttgcttaccttattaatatttgctgaagtaaatggcgaagctggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagtgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagttgtcactgcccacctgagacgtacggaccccagtgtgcatccaaatatgacgactgtgaagggggttctgtggcacgctgtgtccatggcatctgtgaggatttaatgcgagagcaagctggagagcccaagtacagctgcgtctgtgatgctgggtggatgttttcacccaacagccctgcctgcacgctggacagagacgagtgcagcttccagcccgggccttgctccacacttgtgcagtgtttcaacactcaaggctctttctactgtggggcctgtccaacaggctggcaaggcaatggatatatttgcgaagatatcaatgaatgtgagataaataacggcggctgttctgtggctccacccgttgagtgtgtgaatacacctgggtcttcccactgccaggcctgtccaccagggtaccagggtgacggaagagtgtgcacactcacagacatctgctcagtcagtaatggaggctgccacccagatgcctcatgctcctcaactctaggttccttacctctctgcacgtgtctcccgggttatactggaaatggttatgggccaaatggatgtgtgcagctcagtaatatttgcctaagtcacccctgtctaaatggacaatgcatcgacactgtctctggttatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaagtttgtggagagtccctctcaggaataaatggaagcttcagctacaggagcccggatgttggttatgttcatgatgttaactgcttctgggttatcaaaactgaaatgggaaaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgagattcgagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcgcttgcggggatgaattaactggagaaggggtcattcgctcgcctttttttcctaacgtgtatcctggagaaagaacctgtaggtggaccatccaccagccccaaagccaagtcattctcctcaacttcactgtctttgaaattggaagttctgcccactgtgaaacagattatgttgagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttggcatgtggagaaattcttacagaatcaacagggaccattcaaagtcctggccatccaaatgtctacccccacggtatcaactgtacttggcatatattagtccaacctaatcacctgattcatttaatgttcgaaacatttcatctggagtttcattacaattgcacaaacgactacttggaagtttatgacaccgactctgagacatcccttggaagatactgtggaaagtcgatcccgccatctctcacaagcagtggtaactcattgatgctggtgtttgtgactgactccgacctcgcttatgaaggcttcttaataaactatgaagcaatcagtgcagcaacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcagagatggaggctatgaaaaatcaccattgctgggaatattctatggctcaaatctacccccaacaatcatctctcatagtaacaaactatggttaaaatttaagagtgaccaaatagacacaaggtctggattctcagcttactgggatgggtcatcaacaggttgcgggggtaatctcaccacttcaagcggcacgttcatatctcccaactacccgatgccctattaccacagctctgaatgctactggtggttgaaatctagccacggcagcgcatttgaactggaattcaaagactttcacttggagcatcatccaaactgcactttagattacctggctgtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagacatgtgagaatgtggtaatagtcaatcaaacctatggcatcttagagagtatagggtatccgaatccttattctgaaaatcagcattgcaactggaccatccgggcaacaacaggcaacactgtgaactacacatttttagcatttgacttggaacatcacataaactgctccacagattatttagagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacggttgtggtggagagctgtctggggccacaggctccttcagcagccccgggttccccaacaggtatccaccaaacaaggagtgtatctggtacattaggacggaccccgggagtagcattcagctcaccatccatgacttcgatgtggagtatcattcaaggtgcaactttgatgtcttggagatctatggaggccccgatttccactctcccagaatagcccaactgtgtacccagagatcacctgagaaccccatgcaggtctccagcactggaaatgagctagcaattcgattcaagaccgacttgtccataaatgggagaggcttcaatgcgtcatggcaagcagtcactggaggttgtggtgggattttccaggctcccagtggagagattcattctccaaattaccccagtccttataggagcaacacagactgttcttgggtcattcgggttgacagaaatcatcgtgttctcttgaacttcactgactttgatcttgaaccacaagactcttgtattatggcatacgatggcttaagctccacaatgtcccgccttgccaggacgtgtggaagggagcagctggctaaccccatcgtctcctcaggaaacagcctcttcttgagatttcagtctggcccttccagacagaacagaggcttccgagctcaattcaggcaagcctgcggaggccacatcctcaccagctcatttgatactgtttcctctccacggttccctgccaattatccaaacaatcagaactgcagctggatcattcaagcgcaacctccattaaatcatatcaccctctcttttacccactttgaacttgaaagaagcacaacgtgtgcacgtgactttgtagaaattttggatggcggccacgaagacgcgcccctccgaggccgttactgtggcaccgacatgccccatcctatcacatccttcagcagcgccctgacgctgagattcgtctctgattctagcatcagtgctgggggtttccacaccacggtcaccgcatcagtgtcggcttgtggtggaacgttctacatggctgaaggcatcttcaacagccctggctacccagacatttatccccctaatgtggaatgtgtctggaacatcgtcagttcccctggcaaccggctccagctgtcttttatatctttccagttggaagactctcaggactgcagcagagattttgtggagatccgtgaaggaaatgccacgggtcacttggtgggacgatactgtggaaactccttccctctcaattattcttccatcgttggacataccctgtgggtcagatttatctcagatggttctggcagcggcacgggcttccaggccacatttatgaagatatttggcaatgataatattgtgggaactcatgggaaagtcgcctctcctttctggcctgaaaactacccacataactccaattaccaatggacagtaaatgtgaatgcatctcacgttgtccatggtagaatcttggagatggacatagaagaaatacaaaactgctattatgacaaattaaggatctatgatgggcctagcattcacgcccgcctaattggagcttactgtggtacccagactgaatctttcagctccactggaaattctttgacatttcatttttactccgactcttcaatctcagggaagggattccttctggagtggtttgcagtggatgcacctgatggtgttttacctaccattgctccaggtgcttgtggtggcttcctgaggacgggagatgcacccgtgtttctcttctccccgggctggcctgacagttacagtaatagagtggactgtacgtggctcatccaggctcccgactctaccgtggaactcaacattctttccctggacattgaatctcaccgaacgtgtgcctatgatagccttgtgatacgagatggagataataacttggcccagcagctagcagttctctgtggcagagagatccctgggcccatccggtctactggagagtacatgttcatccgcttcacctcggactccagtgtaaccagggcaggcttcaatgcatcctttcacaagagctgcggtggatatttgcatgcagacagagggatcatcacgtcccccaagtatccagagacttacccatccaacctcaactgttcttggcacgtcctggtccaaagtggcctgaccattgctgtccattttgaacagcctttccagattccaaatggagattcttcttgcaaccagggggattacttggtgctaagaaatggtcctgatatctgttctccacccttgggaccccctggaggaaatggtcatttttgtggcagtcatgcttcatcaactctgttcacctcggataatcaaatgtttgttcagtttatttctgatcacagtaatgaagggcaaggatttaaaatcaaatatgaggcaaagagtttagcctgtgggggcaacgtctacatccatgatgctgattctgctgggtatgtgacctcccccaaccaccctcataattatcccccgcacgctgattgcatttggatcttagcggctccaccggaaacacgcatacagctgcaatttgaagatcgattcgatattgaagtaacacccaactgtacttccaactaccttgagttgcgggatggagtggattcggatgcaccaatactttccaaattttgtgggacatctttgcccagcagtcagtggtcctcaggagaggttatgtatttgagatttcgatctgacaacagccccacacatgtgggattcaaggccaagtattctatagctcagtgtgggggaagagtaccagggcaaagtggtgttgttgaaagcattggacatccaacacttccatacagagacaacttattctgtgagtggcatctccaggggctctctggacactatctcaccatctcttttgaagactttaaccttcagaattcttctggctgtgaaaaagacttcgtggagatctgggacaatcatacctctggaaacatcttgggcagatactgtggaaacaccattcctgacagcatagacacttctagcaatactgctgtggtcaggtttgtcacagacggctctgtgactgcctcaggattcagactgcgatttgaatccagtatggaagagtgtggtggggatcttcagggctctattggaacatttacttctcccaactacccgaacccaaatcctcatggccggatctgcgagtggagaatcactgccccggagggaaggcggatcaccctaatgtttaacaacctgaggctggccacgcatccgtcctgcaacaatgagcatgtgatagtattcaatggcattagaagtaactcaccccagctagagaaactgtgtagtagtgtgaatgtaagcaatgagattaaatcttcaggaaacacaatgaaagtcatttttttcacggatggatccaggccatatggcggcttcactgcttcctatacctccagtgaagatgcagtgtgtggtgggtctcttccaaatactcctgaaggaaactttacttctcctggctatgacggagtcaggaattactcaagaaacctgaactgcgaatggactctcagcaatccaaatcagggaaattcatccatttccattcactttgaagatttttacctagaaagtcaccaagactgtcaatttgatgtcctcgagtttcgagtgggtgatgctgatgggcccctgatgtggagactttgtggtccttcaaagcctacattgccattggttataccttattctcaggtatggattcactttgtcaccaacgaacgtgtagaacacattggattccatgcaaagtattcctttacagattgtggcggaatacagataggtgacagtggagtgatcacaagccccaactatccaaatgcttatgacagcctgacccactgctcttcgctgttggaggccccacaagggcacaccatcactctcacatttagtgactttgatattgaaccccatacaacttgtgcttgggactctgtcactgtcaggaatggtgggtcccctgaatcacccatcataggacaatactgtggaaattcaaaccccaggacaatacagtcaggttccaatcagctggtcgtgacttttaactcagaccattcattgcaaggtggtggattttatgctacgtggaacacacaaactttaggttgtggtggaatatttcattctgataatggtacaatcagatcccctcactggcctcagaattttcccgaaaacagcagatgttcctggacggccattactcacaaaagtaaacacttggagatcagctttgacaacaacttcctaatccccagcggtgatggacaatgtcagaatagcttcgtgaaggtgtgggcaggaactgaggaggtggacaaagccctgctagccactggctgtgggaacgtggctccgggtcccgttatcacaccaagtaacacattcactgccgtcttccagtctcaggaggcaccagctcagggcttctccgcgtcctttgttagccgatgtggaagtaatttcactggcccttcaggttacatcatttctccaaattacccaaaacaatatgacaacaacatgaattgcacctatgtcatagaggctaatcctctgtcagtggtcctcttgacttttgtgtccttccacttagaagctcgttccgctgtgacgggaagctgtgtcaacgatggcgtgcacattatcagaggttacagcgtcatgtccaccccatttgctactgtgtgtggggatgagatgccagctcccctcaccatcgctgggccggttctgcttaacttctactccaacgagcaaatcacagacttcggattcaagttttcctataggataatctcctgtggtggtgtgttcaatttctcttctggaatcatcacaagtcctgcctattcatacgcagactacccaaatgatatgcactgtctgtataccatcaccgttagtgacgacaaggtgatcgagctcaagttcagtgattttgatgtggttccctccacctcctgctcccatgactacctggcaatttacgatggtgccaataccagcgatccccttcttggcaaattctgcggttccaagcgcccaccaaatgtgaagagcagcaataatagtatgctcctggtgttcaagacagattcatttcagacagcaaaaggctggaagatgtctttccggcagacattggggcctcagcaaggatgtggtggttatctgacaggctcgaataatacctttgcctctcctgattctgattcgaatggaatgtatgacaagaatttaaactgtgtatggatcataattgcacctgtaaacaaagtaattcacctcaccttcaatacatttgctctggaggcagcaagtactaggcaaagatgcctttatgattatgtaaagttatatgatggggatagtgaaaatgcgaacttggctggaacgttttgtggttccacagtacctgctccttttatctcttctggtaacttccttacggttcaattcatcagtgacttaacattagagagggaaggatttaatgctacatacaccatcatggacatgccttgtggtggaacatacaatgcaacttggaccccacaaaatatttcatcacccaattcatcagacccagatgtcccattttccatctgtacttgggtcattgattcccctccgcatcagcaggtcaagataactgtgtgggcattacagctgacctcgcaagactgcacgcagaattacttacagcttcaggactcaccgcagggtcacggaaattcaagatttcagttctgtggcagaaatgcttcggctgtgccagtgttttattcttctatgagtactgcaatggtcattttcaaatctggagttgtaaacagaaactctagaatgagtttcacctatcagattgcagattgcaacagagactatcacaaggcatttggcaacctgagaagccctggatggccagataactacgacaatgacaaggattgcaccgttactctcacagccccccagaaccacaccatttccctcttttttcattcacttggcatcgagaactcagttgaatgcagaaacgatttcttggaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggatgtggtggaactctttatggagacagaggctcattcaccagccccggctatccaggcacatacccaaacaacacgtactgcgagtgggtccttgttgctcctgctggaaggcttgtcaccatcaacttctacttcatcagcattgacgatccaggagactgtgtccagaactatctcacactctatgatgggcccaacgccagctctccatcctctggaccatactgcggaggcgacaccagcatagctcccttcgtggcttcctcaaatcaggtcttcataaaatttcatgctgattatgcacggcgtccatccgcattccgattaacttgggacagctaagtgggtaacaactcgtgttcactcagcactttccctctgcagcacgctggacagcactctgccatcctgatacatgacccctgctgatgccacagagaataagctgaacttgtatggtttttcaccaaaccatggatagaatcaatatttgtaggccaggcgtggtggctcacccccctgtattctcagcactttgggaggccgaggcaggttgatcacctgaggtcaggagtttgagactagcctggccagcatggtgaaacctcatctctctaacaatataataattagccaggcgtggtggtgggtgcctgtaattccagccactcgagaggctgaggcaggagaattgcttgaacccaggaggcagaggttgcagtgagctaagatcacaccactacactccagcctgggcgagacggcaagactccatctcaaaaaaaaaagaaacaaaaaaaaccagaatcaatatttgtacattttctcgaacatagaatatagcttctttagtcttgagtgtgcatttcattctaatattttgagctgaaatttaaaaaaactttgaaagagttggaaatgattatggcatatgtgacatacatttttaaaagttaataataatagccaggggcagtggctcatacccataatcccagcacgctgggaggccatgatgggaggattgcttgaacctaggagtttgagaccagcctgggcaacaaagtgagacctgatttttacaaaaaatcaaaaaattagccaggcatggtggcatgcacccgtggttccagctacacaggaggttgaagcaggaggatcacttgagcccagtaggttaaggctgcagtgaaaccctgtgaattaaccactgtactccagcctgggtgacagactgagaccctatctcaaaaatgacaacaagaacaacaaaagttaatgataatatagaagcataaatttcctgtgaatgttcaattacacataataaacattattgaattgtacacaa

SEQ ID NO: 70 - DNA, 3108 bp, Homo sapiens
gaaatactcgtctctggtaaagtctgagcaggacagggtggctgactggcagatccagaggttcccttggcagtccacgccaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcca

SEQ ID NO: 71 - DNA, 2344 bp, Homo sapiens
ggtgcgtccgcgggtggctgccccgcaggtgcgcgcggccggggctggcggcgactctctccaccgggccgcccgggaggctcatgcagcgcggctgggtcccgcggcgcccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgagcgcacggtcggggcacagcagggccggggggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagatgggacgggacttgcggcccgggtcccgcgtgctcctgctcctgcttctgctcctgctggtgtacctgactcagccaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggttccagctcctttcctggagcgtgtgtgggggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagctgggcctgaggctggggagaaccagaagcagccggaaaaaaatgctggtcccacagccaggacatcagccacagtgccagtcctgtgcctcctggccatcatcttcatcctcaccgcagccctttcctatgtgctgtgcaagaggaggagggggcagtcaccgcagtcctctccagatctgccggttcattatatacctgtggcacctgactctaatacctgagccaagaatggaagcttgtgaggagacggactctatgttgcccaggctgttatggaactcctgagtcaagtgatcctcccaccttggcctctgaaggtgcgaggattataggcgtcacctaccacatccagcctacacgtatttgttaatatctaacataggactaaccagccactgccctctcttaggcccctcatttaaaaacggttatactataaaatctgcttttcacactgggtgataataacttggacaaattctatgtgtattttgttttgttttgctttgctttgttttgagacggagtctcgctctgtcatccaggctggagtgcagtggcatgatctcggctcactgcaacccccatctcccaggttcaagcgattctcctgcctcctcctgagtagctgggactacaggtgctcaccaccacacccggctaattttttgtatttttagtagagacggggtttcaccatgttgaccaggctggtctcgaactcctgacctggtgatctgcccacccaggcctcccaaagtgctgggattaaaggtgtgagccaccatgcctggccctatgtgtgttttttaactactaaaaattatttttgtaatgattgagtcttctttatggaaacaactggcctcagcccttgcgcccttactgtgattcctggcttcattttttgctgatggttccccctcgtcccaaatctctctcccagtacaccagttgttcctcccccacctcagccctctcctgcatcctcctgtacccgcaacgaaggcctgggctttcccaccctccctccttagcaggtgccgtgctgggacaccatacgggttggtttcacctcctcagtcccttgcctaccccagtgagagtctgatcttgtttttattgttattgcttttattattattgcttttattatcattaaaactctagttcttgttttgtctctccgaaaaaaaaaaaaaaaaaaaaaa

SEQ ID NO: 72 - DNA, 743 bp, Homo sapiens
cgcgcctagcagtgtcccagccgggttcgtgtcgccatggggcagatcgagtgggccatgtgggccaacgaacaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagtacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggtggcggcggggggacccccgggaggtccccaggtcaaccccatcccggtgaccgacgaggtcgtgtgacctcgccccggacctgccctcccgccaggtgcacccacctgcaataaatgcagcgaagccgggaaaaaaaaaaaaaaaaaaaaaaaaaaaaaaaaaaaaaaaaaaaaaaaaaaaaaaaa

SEQ ID NO: 73 - DNA, 2360 bp, Homo sapiens
agcagacagagagaggaggttgtctgggacagactgctcctgacagaaggatgtcccagctgagcctgtcctggctgggcctctggccagtggcagcatccccttggctgctcctcctgctggtcggggcctcctggctcctggcccatgtcctggcctggacctacgccttctatgacaactgccgccgccttcggtgtttcccacaacccccaagacggaactggttttggggacaccagggcatggtcaaccccacagaggagggcatgagagttctgactcagctggtggccacctacccccagggctttaaggtctggatgggacccatctcccccctcctcagtttgtgccaccccgacatcatccggtctgtcatcaacgcctcagctgccattgcaccaaaggacaagttcttctacagcttcctggagccctggctgggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggccatgacaccacggccagtggtctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcggctgcatcccccagtcccggtcatctcccgccatgtcacccaggacattgtgctcccagacggccgggtcatccccaaaggcattatctgcctcatcagtgttttcggaacccatcacaacccagctgtgtggccggaccctgaggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttatacgaaatttccagaacaggccaatctgaagagatgcatagcggattggtggctttcagcagctgtggggaggtgggactgaggagcgactgctaatcagtatggggtttcctcccgggatggtgaaaatgttccggacctagatactgacgaaggtagcacgacactgtgagtgcactaaatgctattgaattggacactttgaaatggtgaatttcgtggtatgtgaattctacctcaatcaaaaaaatttgctattttatctcacatacattttttttctgtccaggttgttcatataataatatgctgtgagcatctttccatgacattaaatcatcttaggaaacatt

SEQ ID NO: 74 - DNA, 2812 bp, Homo sapiens
accccagccatgcccgccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaagacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacagaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtgggaaaaaaaaaaaaaaaaaaaaaaaaaaaaaaaaaaaaaaaaaaaaaaaaaaaa

SEQ ID NO: 75 - DNA, 5896 bp, Homo sapiens
atgctgggagatgcagtccctttttctaaagactggggcggccgtgaggtcatcggtggtcgccgggagccgccagcacgtggcggcgaggaaggggcggtgtgctcctgttgtctgcacctgagagggggcaggagctctcggcgcttgcgcctcccgccgcggtgccctcccgacatgccggaggaggcgggcttcccgccggccaagagattccggccaggctctggacctccgagccgcgctgggtccttccctcccgggaggcaagtggtgatgctgctgactgcgggcagcggcggcagaggaggaggaggaggccggaggcagcagccgcccctggcccagccctcggccagtccctaccctgaagctgtggagctgcagcgccggagtctgcccatcttccaagcgcgggggcaactgttggcccagctccgaaacctggacaacgcggtcctcatcggggaaactggctctgggaagacaactcagatccctcagtacctgtatgaaggagggatcagccgccagggcatcattgctgtgacccagcctcgtcgagtagctgccatctctcttgctactagagtctcagatgagaagagaactgaacttgggaagctggttggctatacagtgcgctttgatgatgtcacctcagaagacaccaggatcaagtttctgacagatggcatgcttctgcgtgaagcaatttcagactctttgcttcggaaatacagctgtgtcattttggatgaagctcacgaacggactatccacacagatgtgctctttggagtggtgaaagctgcacagaagaggagaaaggaactcgggaaacttcctctgaaagtgattgtgatgtcagctacgatggatgtggacctgttctctcagtatttcaatggcgcccccgtcctctacctagagggtcggcagcatccgatccaggtgttttacaccaaacagcctcagaatgattacctgcacgccgcgcttgtctccgtcttccagatccaccaggaagccccttcttcacaggacatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaagggctatcgcaaagtgatcatttcaaccaacatcgctgaaacctccataaccattacaggaataaaatatgtagttgacacgggcatggttaaagcaaagaagtataaccctgacagtggtcttgaggtgttagcagtgcagcgggtatcgaagacgcaggcttggcagcgcacagggagggctggcagagaggacagtggcatctgctaccggctctacacggaggacgagtttgagaagtttgataagatgaccgtgccagagatccagaggtgtaacctggccagtgtgatgcttcagcttctagcaatgaaagtcccaaatgtgctcacctttgacttcatgtcgaagccatctccagatcacattcaggcggccattgcccaactggacctgttaggtgctcttgaacataaggatgaccagcttaccctgactccaatgggaagaaagatggcagcatttcctttagaacccaaatttgccaaaaccatcctcatgtcccccaaattccactgtacagaggagatcctgaccattgtctccctgctgtctgtggacagcgtcctccacaaccctccttcccggcgagaggaagtgcaaggggtccgcaagaagttcatatccagcgagggggatcacatgaccctgctcaatatctatcggaccttcaaaaacctaggcggaaataaggattggtgcaaagagaattttgtcaacagcaagaatatgacgctggtagcagaagtcagagcacagctgagggacatctgcttaaagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcgggacctctgcgtcatagatgcacagtggctgtacgaggctgcccctgagtactttaggaggaagctgagaaccgccagaaactgagccgccccaggatgccgccagaatcactggtccctgggagcttggactacagttgtccttacagcaggcttccaggttggcgcttagagaagccttggaatcagctgaaggtgcctgacttccaggagcgtgaaagcatctttgctcaactcctgggactgaaccatatagacatggacatatcatttgtacctggaaacctcaaaattatgcttttggttcttactgggtgactttgacttaatttaacacctgagcctcagttttctcatctgccaaatgggagtaataataataatccttataaaattgggttcataaagtttagagaaaaggaatggaaagtacccagaactatgcctggagcacgcacgacacacgtacagtgagttgggagccgttaggctgaatgttactgcttgccatatgatgtgaagtacagcaatatcccaagttcttgtgactgagggagattttctggaagggccacaggaggttgcggagcttggatgttgcccttagttcttgtttaatgtctctctgaatgcagttttaaaatagaaaacaaaactgacttctgtagaagtttccagagggaggtgctgttatctcgtacctcctgggatggcgatccctactgaacgcttgtgtctcagggtggaccactctgtgtctgtctccaagcagagaccagtaaaggagcctcctggtcctcagtgcgtgaccctgtcagtgctttcaggagacatgtaagcttcctgggtgaaggttgatttgtaccttctgaatcctgtcacgtgtagacatgggaaactgacctatcagtgttttgtgtgtgtaggtgactcccacatacacagttgccatttttctctctaactgggcaccagtgaacatgcgggcatgaggagtgactgtgtaccatttcagctgtttcttttcgggcagtcccctggtcagagggggtgggggtgggggaggggagaggggtacctagaacccagagaacattggcttatgccagataccacaccacatctgggcttacattcttgtatcttttttggtgtgtgggcggggggggtggggggcagttcagtgaagtctagaagacctgctggacaaattctaaaagagctagagctgtaacacttattcttgcatcttattaattttctatgatattttttccttcttcgtagggacttgggacaatctggctttgctgctttctaactgctaggcacctctctctaaccctcattgtcagagggaattggaggatatccacagtctgttcctgttctgatattctgagcagagaaaaggcactaacggttcctcttagctatttaattatcagaagcaagtaatctttccccagataatattttgccctagaagaagccgtgatttagctcttttattgtgcttacttggtccaaatacatctgtggggtgttttgtcatttcttaatgaatgaatcatagttataaccaggggccaagctgcccaagaggctcttcagagatcatggatgctctctttctggaagctgtggcctgatggagcagccccattccagggtcccatctgtccggagttgtgtatgtcaagtccggctcagtctttatttccaacactagccgtggtcctgtgcagtcaagctctcagctagtgtttagggctgtctgtcagaaatggttatacgtgggcaaaagaagatctgacagctcctatataccttatcttactgaattcttaaactttgaaccagttcttccacttactgacttgttaccactgctgactttctgaaaagttttccagtttttgttttttgttttttgttttccagtaggggattagaatgtttagtcctacttagtaagaaaaatattgtatttttaatcattcatagtgctggtaaaaaaaaaaaaaaaaaaaaaaaaattggggggtggccgggcgcagtggctcacacctgtaatcccagcactttgggaggccaaggcgggcggatcacctcatgcctgtaatcccagcattgggatgggaggctgaggtgggtggattgcttgagaagttcaagaccagcctggccaacatggcaaaaccccgtctctactaaaaatagaaaacttagctgggcatggtggcacacgcctgtaatcccagctaccggggaggctgaggcacaagaattgcttgaacttgggaggcagagtttgtagtgagccaagatcacgccactgcattccagcctggccgacagtgtgagacggtctcagaaaaaaaaagaaagaaagaaagaaaaagaaaaaacttggggtaatttatgtccagcttaagtacctgaacagtttccggaaatgtatattttttttctgagaggcaaaggatgtaaacagcttctaagtagctttaatgtttctgtacagaaataagtttatccctgtaacattgtggtagagttttaatacagtatttagttttttattgggcttttttaaaaagttaacttttaacatagctgctcagggattaaatcagattggaaaacccattctgactccacatactgctacaaagaaatacatcgttgtttatattgagctgcaggagatagtacactttaaacttaagaaagttaaatgtttcacaataacattgcaatataatcttcagctactctctttccattggtaaaatctctgatggtgtgataactctttgccaacctacgaaacccatatctggaagaatcaccagctcccgtgagcagcttcatgtaaatagatgcactccaagcagattgcatgcctcaggtgtttgtcttctagtaatcatggagtgtgcaacacccagagtaacactacaaggggcaggactgcaaacagcaggtcctggctaaaaacccttaatgctgcattgctgccagttgtaaagagatgcctgaatggaggcaagttctgccctgtgggtgaaactgatgatgtactgtactgtcatatataaatccactaaatccagctaccaggaactgcctggaactgtggccatgcatttttttttttctttaaagaccagtgtgatagtaggccatgcatctgagatacgatattccttggtaactagagggagaaaaaaaaatcaagtaggttcaggcttatgttgtattttgagagtctggttttatttgaacagaaataactctacagaaagctcttgtaaataatgctcaaatttgcacccgacgatcaaatccattaaaaatgaatcttgtatatgatgtgtgtggcttgtttcttgcatctcttttccattattcatagaaaattatttagaaaatattaagtgttagtcttaccatgagttagtaagacataccttcttagtagcttatatgtcctgtatatcctgggaaggtaggattgttgatttttaataaatctgaaccctgtctttgggttatattaatttactggagaaactcacagaactcagggaaacacatttaccggtttcatacaaaagatatgaccaaggatacagataaggagatgagcagggtggggaatggggaagaagctc

SEQ ID NO: 76 - DNA, 10580 bp, Homo sapiens
tttccgcagctgagcggcgacccgggcggcggcggcggtcgaggagctcccatggcagggacgaggcggagggaaggcgaaaggggggcgaggagttaagccagagcctccgcggggcgggtttccgagggaggcacagagggaaacggctctcgcagcccgaggagggtcaggcgcggagcttgtcgcacctcccgcgcattctgtccagcccgggctccggagatgcatctgcatcaggtcctcaccggagctgtcaaccctggagacaactgctactccgtgggcagcgtcggggatgtccccttcacggcatatggatcaggctgtgatattgttattttggcaaatgactttgaatgtgtacagatcattcctggtgctaagcatggaaacatccaagtcagctgtgtggagtgttctaaccaacaaggaagaattgcagcttcatatggtaatgctgtttgtatatttgagcccttgggcataaattctcataaaagaaattgtcaactcaagtgccagtggcttaaaactgggcagttttttttgagttctgtgacatacaacttagcatgggatcctcaagataatagattgttgacagcaactgattctattcagttgtgggctcctccaggagatgatattctggaagaggaggaagaaattgataatacagttcctcctgttttaaatgattggaagtgtgtctggcagtgcaaaacctcagtatctgtacatttgatggaatggtctcctgatggtgaatattttgctactgctggaaaggatgattgtcttttgaaagtgtggtatcctatgactggttggaagtcttcaattatacctcaggatcatcatgaagtaaaaaggagacagtcctctactcaattttcttttgtttacttggcacatccccgagctgtgacaggtttttcgtggcgcaaaactagcaagtatatgcccaggggttctgtctgtaatgtgttgttaacttcatgtcatgatggtgtgtgccggctctgggcagaaactttattaccagaagactgtcttttgggtgagcagatttgtgagactaccacttccagcattgccagcagcctttctcatgctggaagacacaaagacagaatacagcatgctcttgagacaatacaccatttgaaaaatttaaggaaaggacagaggaggtcatctgttcttgtaactcatgctgaattaatgcccgaccagacagcaatgcatgaagttcaaagacacatttcccaccatgcaaatgcactctgtcattttcatattgcagcaagcatcaaccctgccacagatattccaaatgtcttggttggcactgcatttaatgttgatgatggaaatgggggctttgtagttcattggttaaacaacaaggaatttcattttacatcatctacagaagtatttatgcatcaattacgaaaactttctgataagcaggtagatcatgaaaatgatgatgcagatagagaagatgaggaacattcacaggaggatagagaacggggtttacatatgaaattagaccatgatttatccctggatagagaatctgaggcaggtacaggatcatcagaacatgaagatggagaaagagaaggaagtcctagaacttactcacgacttagtgtaccaatgccactgcctacggttctgcttgatcggaagattgaaacgctgctaactgaatggaataagaatcctgatatgctttttacaatacaccctgtagatggtacctttctagtgtggcatgtgaagtatttggatgaatataatcctggaatatttagacaagttcaggtttctttttcttctcggattcctgttgcatttccctctggtgatgcaagctctcttagtaaaaatatcatgatgtatgcctgtataaatgcgacaaaagattctcaccacacgctgttacaccaggaggggatgtctgtaggcagtcctcacggatcacagccacactctagatcccacagtacacatatgaacatcttagctcccacagtaatgatgatctctaaacacatagatggttctttaaatcagtgggcagtcacttttgctgataagtctgcctttaccactgttctaactgtatctcacaaatttagatattgcggtcatcgatttcacctcaatgacctggcatgtcattcagttttaccactgttattgacatcctctcatcataatgctctattgactcctgaattagattgtcagtgggactcagacaataaattaagtagattaatggaccctgtaaaacatataaaaggttcctcgaaacaacctcttagaaatgcagcaactcgtacatttcatgacccaaatgcaatctacagtgaacttattctgtggcgtgtagacccaataggacctttgtcatacactggaggagtatcagaattggctcgaattaactctttacatacctcagcgttctctaatgtggcttggcttccaactctcattcccagttactgtctaggcacatactgcaattctgcaagtgcttgctttgttgcttctgatggcaaaaatctgagactctatcaagctgtagtggatgcaaggaaattattagatgaattgtcagacccagaatcttcaaaacttattggagaagtgtttaatattgtgagccaacagtctactgctcgacctggctgcattattgaactcgacgcaataaccaaccaatgtggctcaaatacacagttgcttcatgtgtttcaagaagacttcattataggatataaaccacataaggaagatatggagaaaaaggaaacagaaatattttttcagccatcacaaggataccgcccaccaccattttcagaaaagttctttctagtagtaattgagaaggacagcaataataactctattctgcatatgtggcaccttcatcttaaatctgtacaagcatgtttagctaaagcttcagaaggggcttcctctgagagtctactttcagtccctggacagaagaacgtagattcttctccagaaacctctcctagtgtgagccccatgccacattcttcatcaattgccaatcttcaaactgccagtaaacttattctgagttctagactggtgtatagccaaccccttgatctcccagaatcagttgaagtaataagagcaacgccttcagcaggccatctgagttcttcttcaatttatccagtgtgccttgcaccttatttagtggttacaacttgttctgacaataaagtacgcttctggaaatgttgtatggaagccaacccagagtgtaataaaagtgatgagaaagaaatttatcattggaagagatggcctttgatgaatgatgaaggagaagataatagcagtacagtgagcattgtgggaagaccagttgctgttagctgttcatacacaggtcgccttgcagtggcttataagcagcctatccaccataatggttttgtttctaaagaattttccatgcatgtttgtatatttgaatgtgaatctacaggaggatcagagtgggttttagaacaaacaattcatcttgatgatttggttaaggttgggagtgtacttgattcaagggtcagcgtcgacagtaatctgtttgtgtatagcaagtcagatgcactcttgagcaaggatagatatcttattccgaatatcaaacatttagtacatttggactgggtatcaaaagaagatggctcccacattcttacagtgggagtcggtgcgaatatcttcatgtatggaaggctttcaggaattgtgactgagcaaaccaacagtaaggatggagtagctgtcatcactttaccactaggtggtagtatcaagcaaggagttaagtcaagatgggttcttcttagatctatagacttggtatcttctgttgatggtactccttcactgcctgtttctctctcttgggtaagagatgggatattggtggtaggaatggattgtgaaatgcatgtatatgcacagtggaagcatgctgtcaaatttggagacactgaagctgatagttctaatgcagaagaggcagcaatgcaagatcattcgacctttaaatctaatatgctggcaagaaaaagtgttgttgaaggaacagctatttctgatgatgttttttgttcaccaactgtaattcaagatggtggcttatttgaggctgcacatgtactttcccctactcttccacaatatcatccaactcagctgttagaattgatggatttagggaaagtgcgaagggctaaagccattctctctcatttagtaaaatgtattgcaggtgaagtagcaatagttagagatcctgatgctggagaaggaactaagcgacatctctctcgaactattagtgtaagtggcagtacagcaaaggaaacagtcaccgtaggaaaagatggtactcgagattatactgagatagattctatccctccactaccactatatgcattacttgctgcagatcaagatacatcctacagaatttcagaagaaagtacaaagataccacagagctatgaagatcagacagtaagtcaaccagaggatcagtattcagagctgtttcaaatccaggatataccaacggatgatattgatttagagcctgaaaagagagaaaacaaatcaaaagtaataaatctttctcaatatggaccagcttactttggccaagaacatgcaagggtactttcaagtcatcttatgcactcaagtctaccaggccttacccgtttggagcagatgttccttgtagctttggctgatacagtggctactactagtactgagcttgatgaaagcagagataagagttgctcaggaagagatacattagatgagtgtggtttgagatacttgttagctatgcgcctacacacatgccttttgacatcgctgcctcctttataccgagtgcagctacttcatcaaggtgtctctacatgccattttgcctgggcttttcattctgaggctgaagaagaactgattaatatgattccagcaattcagagaggggacccccagtggtctgaattaagagctatgggcataggatggtgggtgaggaacattaacacgcttcgaagatgcattgaaaaggttgccaaagcttcttttcaaaggaacaatgatgccttagatgctgcactattctacctttcaatgaagaagaaagcagtagtgtggggtctgtttaggtcacagcatgatgaaaaaatgacaacatttttcagccacaactttaatgaagatagatggcgaaaagctgctttgaaaaatgctttttccttacttggaaaacaacgctttgaacaatcggctgcttttttcttgctagctggttcattgaaagatgccatagaggtatgtcttgaaaaaatggaagatattcagctagccatggttattgcccgtttatatgaatctgaatttgagacttcatccacttatatatccatcctaaatcagaagattttgggttgccaaaaggatggctcaggattcagttgcaaaagattacatcctgatcctttcctgcgtagtcttgcctattgggtaatgaaagattacacccgagccttggacacattactggaacaaacaccaaaggaggatgatgaacatcaagttatcatcaagtcttgtaacccggtggcatttagtttttataactaccttcgaactcatcctttgctcattcgaagaaatcttgcctcccctgaaggaactttggcaaccttaggtctcaaaactgagaagaactttgttgataaaattaacctcatagaaagaaaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttagagtttttagtttgatactgtttttgaccattgagatttttaatttgataaaa

SEQ ID NO: 77 - DNA, 1788 bp, Homo sapiens
actggagaggcagagaggagtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcggccacggcaaacaaccgctttgagctgtggaagctgggcatcacccacgtgctgaacgccgcccacaagggcctctactgtcagggcggccctgacttctacggcagcagtgtgagctacctgggggtgccagcccacgacctccctgattttgacatcagtgcctacttctcctctgcggctgacttcatccaccgtgccctcaacacgcctggggccaaggtcctggtgcactgtgtggtgggcgtgagccgctctgccacgctggtcctggcctacctcatgctgcaccagcggctgtccctgcgccaggcggtgatcaccgtgaggcagcaccgatgggtcttccccaaccgaggcttcctgcaccagctctgcaggctggaccagcaactgcggggtgccggccagagctgaggggccagagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagacaaaaaaaaaaaaaaaaaa

SEQ ID NO: 78 - DNA, 1362 bp, Homo sapiens
actggagaggcagagaggagtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagacaaaaaaaaaaaaaaaaaa

SEQ ID NO: 79 - DNA, 4221 bp, Homo sapiens
tagtctctgactcgctcgggcagaggccgaggaagccggttccggggacgggcaacagggactcagggaccagaaggcggctgcaggacgcgaccgagcaggaccccaggcccgggaacgacgtcgcgagcgctgagactgccgggcctcccagcccatctggcattcgagcgcaggaccgggcgccccggcaccgccgcgcgccacccgctaggatgccggtggccccagcgccctcagccgacggaggagccctttttcaacgccctcgctggagtctggcctgcacgccttgctgaatgaagccggaacctcagccccgcttccctttgaaatgaatgttcctggggcgccctctcgtggattttggagctaatcgtctgtgaatgccaagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttcacgctgggcgccctgcccattctgggctggaactgcctgcacaatctccctgactgctctaccatcctgcccctctactccaagaagtacattgccttctgcatcagcatcttcacggccatcctggtgaccatcgtgatcctctacgcacgcatctacttcctggtgaagtccagcagccgtaaggtggccaaccacaacaactcggagcggtccatggcactgctgcggaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagccccctcatcctgcatcatggacaagaacgcagcacttcagaatgggatcttctgcaactgatcgtctccatgcgccctgctctgcggctgtgttcttatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaagaaaagtgaacacgtttgtagaactttcataagcacacagttgctgtgttgagttctctttaaaaacaaggacaaaaccaaccagcgttcaaaggaacctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccgctgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaaccttgaagtttggaaacaggtggtcttctatgctgcagagaaactatgcattaggtctcttttcaattagaaacctttactatttccaatgtatgtttgttaaaaataataataataaaaccaaaagcctttgtggaaacccaaaaaaaaaaaaaaaa

SEQ ID NO: 80 - DNA, 1582 bp, Homo sapiens
aggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaaagggcacttgggctgaaggatcgctttgagatctgaggaacccgcagcgctttgagggacctgaagctacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatcctccggagagagagagaggaaggagattccacacaggggtggagtttctgacgaaggtcctaagggagtgtttgtgtctgactcaggcgcctggcacatttcagggagaaactccaaagtccacacaaagattttctaaggaatgcacaaattgaaaacacactcaaaagacaaacatgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatg

SEQ ID NO: 81 - DNA, 1954 bp, Homo sapiens
gtgactaataacacaataacattgtctggggctggaataaagtcggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgaggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatcctccggagagagagagaggaaggagattccacacaggggtggagtttctgacgaaggtcctaagggagtgtttgtgtctgactcaggcgcctggcacatttcagggagaaactccaaagtccacacaaagattttctaaggaatgcacaaattgaaaacacactcaaaagacaaacatgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatg

SEQ ID NO: 82 - DNA, 1234 bp, Homo sapiens
gtgactaataacacaataacattgtctggggctggaataaagtcggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaactccaaagtccacacaaagattttctaaggaatgcacaaattgaaaacacactcaaaagacaaacatgcaagta

SEQ ID NO: 83 - DNA, 2110 bp, Homo sapiens
gtgactaataacacaataacattgtctggggctggaataaagtcggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatcctccggagagagagagaggaaggagattccacacaggggtggagtttctgacgaaggtcctaagggagtgtttgtgtctgactcaggcgcctggcacatttcagggagaaactccaaagtccacacaaagattttctaaggaatgcacaaattgaaaacacactcaaaagacaaacatgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatg

SEQ ID NO: 84 - DNA, 2808 bp, Homo sapiens
gcggcggcggcggcgcagtttgctcatactttgtgacttgcggtcacagtggcattcagctccacacttggtagaaccacaggcacgacaagcatagaaacatcctaaacaatcttcatcgaggcatcgaggtccatcccaataaaaatcaggagaccctggctatcatagaccttagtcttcgctggtatactcgctgtctgtcaaccagcggttgactttttttaagccttcttttttctcttttaccagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaaaaaagtgatgtacaacc

SEQ ID NO: 85 - DNA, 2494 bp, Homo sapiens
agttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatgg

SEQ ID NO: 86 - DNA, 3265 bp, Homo sapiens
ggctccgcgtccggcgcctgtttgtgctgcggcgctgtggcaccggacggccctgccaccccacccccgggagccgagagcggccccgggagagtccgagggcccgggggggtctggagactgcggccccgggcccacagcgccccctccaggccccttccccgcgcccgacagcgccccctcggggtggtggtacggcgcccttcgcgcgcgccccggggtgcttccccttcccctctccccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgaaaaaaaaaa

SEQ ID NO: 87 - DNA, 2829 bp, Homo sapiens
gactagtctatgcacggccgaagcttgagtcatcatcagggaagtaaatgtggttagaaatctgaagtccagtaattttccttgtcatattaattactttgctattaagctgtcactttgcttagccttctccccccaggaaaaagccttttctgtccatgctgggtatgaacatgctactcatcactttgttcttgctactccccttatccatgttaaaaggagaaccctgggagggatgcctccactgcacccacactacgtggtcggggaacatcatgactaaaaccctgttgtatcacacttattatgagtgtgctgggacctgcctaggaacttgtactcacaaccagacaacctactcagtctgtgacccaggaaggggccagccttatgtgtgttatgaccctaagtcttcacctgggacctggtttgaaattcatgtcgggtcaaaggaaggggatcttctaaaccaaaccaaggtatttccctctggcaaggatgtcgtatccttatactttgatgtttgccagatagtatccatgggctcactctttcccgtaatcttcagttccatggagtactatagtagctgccataaaaataggtatgcacaccctgcttgttccaccgattccccagtaacaacttgctgggactgcacaacgtggtccactaaccaacaatcactagggccaattatgcttaccaaaataccattagaaccagattgtaaaacaagcacttgcaattctgtaaatcttaccatcttagagccagatcagcccatatggacaacaggtttaaaagcaccgctaggggcacgagtcagcggtgaagaaattggcccaggagcctatgtctatctatatatcataaagaaaactcggacccgctcaacccaacagttccgagtttttgagtcattctatgagcatgttaaccagaaattgcctgagccccctcccttggccagtaatttattcgcccaactggctgaaaacatagccagcagcctgcacgttgcttcatgttatgtctgtgggggaatgaacatgggagaccaatggccatgggaagcaagggaactaatgccccaagataatttcacactaaccgcctcttccctcgaacctgcaccatcaagtcagagcatctggttcttaaaaacctccattattggaaaattctgtattgctcgctggggaaaggcctttacagacccagtaggagagttaacttgcctaggacaacaatattacaacgagacactaggaaagactttatggaggggcaaaagcaataattctgaatcaccacacccaagcccattctctcgtttcccatctttaaaccattcttggtaccaacttgaagctccaaatacctggcaggcaccctctggcctctactggatctgtgggccacaagcatatcgacaactgccagctaaatggtcaggggcctgtgtactggggacaattaggccgtccttcttcctaatgcccctaaaacagggagaagccttaggataccccatctatgatgaaactaaaaggaaaagcaaaagaggcataactataggagattggaaggacaatgaatggcctcctgaaagaataattcaatattatggcccagccacctgggcagaagatggaatgtggggataccgcaccccagtttacatgcttaaccgcattataagattgcaggcagtactagaaatcattaccaatgaaactgcaggggccttgaatctgcttgcccagcaagccacaaaaatgagaaatgtcatttatcaaaatagactggccttagactacctcctagcccaggaagagggagtatgcggaaagttcaaccttactaactgctgcctggaacttgatgacgaaggaaaggtcatcaaagaaataactgctaaaatccaaaagttagctcacatcccagttcagacttggaaaggatagtctccagattcccttttcagaggttggttctcatcccttggaggatttaaaaccttagtacaaatagtcctagccatattgggagtttgccttatactcccttgtctcttacccctcattgtcaaaaatatccaaacagccatagaggctcttgtggacagacggactaccacacgactaatggccctaactaagtattaacccctgccaagaaaagagctacttcctcttgaagtaaatgaagatagtgatgctttctcttaaactttacttataaaaagcatcaaaggggggaatgaagcaggaaatataaaaggaaaaacaagtaaagggaaaacaagtcctttcctgaccagtctgactcactccaaagtcctgctggagctatgataattatctgcaaggccaggcaggggctccgaaggagtgggctccaggagcagggatgagaaaaacaagttctccttatcagtttccctgtttgaaattctctccccataacattattctttgttctgctctcacaactatttttgtaactatttctgcaagtctgtaaagattttgtaagttcttgtttttctttctgtagcatggcaaggtcacaagacatgtttaagtaaggtaggctcatgttgcaaatcctgttgtaaaacctgtcacggtatgattaactgcctttgttctgcttctgtaagactgctttctcacctcgcaggttttgcgccaaaaacccgacttgcccctgcctgatgcatgtataaaagtcaagccctgtctttgttcagggctcagcctttggatgttaatccgctgggccagtggccacctaaataaaaccttcctgttgcaccca

SEQ ID NO: 88 - DNA, 3138 bp, Homo sapiens
cccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttgagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaactttaaaaaaaaaaaaaaaaaaa

SEQ ID NO: 89 - DNA, 3140 bp, Homo sapiens
cccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttgagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaactttaaaaaaaaaaaaaaaaaaa

SEQ ID NO: 90 - DNA, 3245 bp, Homo sapiens
cccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagagaactagtgaatcccagtcactgagtggagttgagagtctaagaacctctgaaatttgagaactgctggaccagagcctttagagctctgataaggtgtcaacagggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttgagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaactttaaaaaaaaaaaaaaaaaaa

SEQ ID NO: 91 - DNA, 3863 bp, Homo sapiens
atttaagagccaactgtcttgtctttcccgagtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacttcagtcgtccatatgaccccagaagggatctcttcagggtggaatacgtcattggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaagatgatgctgtgtatctggacaatgagaaagaaagagaagagtatgtcctgaatgacatcggggtaattttttatggagaggtcaatgacatcaagaccagaagctggagctatggtcagtttgaagatggcatcctggacacttgcctgtatgtgatggacagagcacaaatggacctctctggaagagggaatcccatcaaagtcagccgtgtggggtctgcaatggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatttttacgatgccttggaataccagcaagaattgttaccaattatttctctgcccatgataatgatgccaatttgcaaatggacatcttcctggaagaagatgggaacgtgaattccaaactcaccaaggattcagtgtggaactaccactgctggaatgaagcatggatgacaaggcctgaccttcctgttggatttggaggctggcaagctgtggacagcaccccccaggaaaatagcgatggcatgtatcggtgtggccccgcctcggttcaagccatcaagcacggccatgtctgcttccaatttgatgcaccttttgtttttgcagaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagaattcaagaaggagacgttcgacgtgacgctggagcccttgtccttcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtccgtggcactcaggtagttggttctgacatgactgtgacagttgagtttaccaatcctttaaaagaaaccctgcgaaatgtctgggtacacctggatggtcctggagtaacaagaccaatgaagaagatgttccgtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggctccagagtggagatcccacatatttcaaaaacatgcttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatgttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctaagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgattatatttgca

SEQ ID NO: 92 - DNA, 2731 bp, Homo sapiens
ctcccacgggctggctggcaagcggccctggtgggtctgcgggggcaggggcagccttcctggtttatctctaccggcgcgatctgctcgtccgcctcggctccagaagctggggctcagggtccggcgaggcaggaagcctgaggccacagcccagagcagcctgagtgcagtcatgtgggggcgactgctcctgtggcccctggtgctggggttcagcctgtctggcggcacccagacccccagcgtctacgacgagagcgggagcaccggaggtggtgatgacagcacgccctcaatcctgcctgccccccgcggctacccaggccaagtctgtgccaatgacagtgacaccctggagctcccggacagctcacgggcactgcttctgggctgggtgcccaccaggctggtgcccgccctctatgggctggtcctggtggtggggctgccggccaatgggctggcgctgtgggtgctggccacgcaggcacctcggctgccctccaccatgctgctgatgaacctcgcggctgctgacctcctgctggccctggcgctgcccccgcggatcgcctaccacctgcgtggccagcgctggcccttcggggaggccgcctgccgcctggccacggccgcactctatggtcacatgtatggctcagtgctgctgctggccgccgtcagcctggatcgctacctggccctggtgcacccgctgcgggcccgcgccctgcgtggccggcgcctggcccttggactctgcatggctgcttggctcatggcggccgccctggcactgcccctgacactgcagcggcagaccttccggctggcgcgctccgatcgcgtgctctgccatgacgcgctgcccctggacgcacaggcctcccactggcaaccggccttcacctgcctggcgctgttgggctgtttcctgcccctgctggccatgctgctgtgctacggggccaccctgcacacgctggcggccagcggccggcgctacggccacgcgctgaggctgaccgcagtggtgctggcctccgccgtggccttcttcgtgcccagcaacctgctgctgctgctgcattactcggacccgagccccagcgcctggggcaacctctatggtgcctacgtgcccagcctggcgctgagcaccctcaacagctgcgtggatcccttcatctactactacgtgtcggccgagttcagggacaaggtgcgggcagggctcttccaacggtcgccgggggacaccgtggcctccaaggcctctgcggaagggggcagccggggcatgggcacccactcctctttgctccagtgacacaaagtggggaaggctgtactgggtcgaacagggtcccttcccccacttcacgtccttcctgggacctcagaatgtgaccttatttggaaatagggttgttacaactgtcactagcggaggtcactttggagaagggtgggccttacatccagtgtgggtggtgtcctcataagataaggagaggccaggcctggtggctcacgcctgtaatcccagcactttaagaggccaaggcggatggatcacttgagcccaggagttcaacaccagcctgagcaacatggtaaaaccccatctctaccaaaaatacaaaaattagctgggcttggtggctggcgcctgtaatcccagctactcaggagactgaggcagaaggatcgcttgaacctgggaggcagaggttgcagtgagccgagattgcgccactggactccagcctgcgtgacagagagcctgtctctaaattaattaattaattaatttaattcaattttaaaaagacgaaaagtgacggccaggtgcagtggctcacgcctataatctcagcactctgggaggccaagatggaggattgcttgaagccaggagtttgggaccagcctgggcaacatagggggatcccatctctacacacaaaaaaattttttaatgaaccaggcattgtggcatgcgcctatagtcccagccactcaagaggcacaggcgggaggatcacttgagcctgggaggttgtggttgcagtgagctatgattgtaccactgcactccagcctgggcaacagagcaagaccttgtctcaaaaataaacaaactaaaattaaaaaaagaagacgagagatagtgggtgtggtggctcacacctgcaatcccagcactttggaaggccgaggtgggcagatcatctgaggccaggagttcaagaccagcctggctaacatggtgaaatcctatctctaccaaaaatacaaaaattagccaggcgtggtggtgggcacctgtactggggaggtgcccacccagctactggggaggctgagtcaggagaatcgcttgaacctgggaggcggaggttgcggtcagctgagatggtgccactgcactccagcctgggcgaaagagcgactctgtctccaaaaaaaagagaagaggagaggacacagagacacacagagaagaaagccatgtggcggcagaggcagagatgggagtgatgcggacggacacaaactaagggatgccacgatgccaagcacagccaacagccaccagcagccaggagacaggcctgggacgggctctccctcacagcctccagagggaaccagccctgccaccaccttgaccctggacttctggcctgcagaactgtgagacaataaactctcattgttttaa

SEQ ID NO: 93 - DNA, 9179 bp, Homo sapiens
gcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaatcaggtcattccgaaactcatcattgaatcaggaagaagaagagttcaatcttactgccctagctctggagaatggcactgaattcgtttcttcaaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctatggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaagcttttataatgtaactccttgctaccagtaagtaagataatggctattacttctgcattaatttgaatacaggtaggaaaatatcaagaaccaacaagaaaagggcttatctttcttaatgattgaaaatgctatgaagtaatatttatgtagttaaaatgcttcattataactcttttaaatcctttacacactagtaaaacagatattactttaaataataattgatagacctggataactttcacaaacacatgattttttaatggtttttcttgagtgaagagaaaaacaatattatcaaatgaaataagtacttaaaatatcctgtctttcccatataacaatgatttttctgactttccatgagtaaaaaaacagccaagcatctttccagtagccccattgaaattgtgaatccgtcctggtctccctaaggactgcacacattgatattcaaggttggtggtcattagatatggaacagaactgaaataaccatggtagaactgaatgtgtaatgttggctttattctagctggtactacatggcacacagtttcaaaacataatttcacctactggaaagctcagacctgtaaaacagagcatgggaactgctggtctaaatgcagttgttcctgctcaaagagacctctggccaaactggcaagcagttaaagttttctttcagggccttcctctctatggcctcaacttcctcctctctcttcttccagcaacttcccctttcatcattcctttccctggggacttggcattcagtgatcctgtagatattgcacaactggggaacctttagacatccttaaaatcacatgagatagacagtcatttggggtgtctgaaataaaccaccccaaaacttagtgttaaaagagcaaccaaaaaaaatttatgtgagattatggatttgttacttagcttgatttaatcatcctgtaacgtgtacatatatcaaaatgttatgtataccataaatatataaaattttatcaacgaaattcataacaatctctcagaccacagagaaatcaaattagaactgaggactaagaaactcactcgaaaccacacaactacatggaaactgaacaacctgctcctgaatgactactgggtaaataatgaaattaaggcagaaataaataagttccttaaaaccaatgagaacaaagagacaacataccagaatctctaggagacagggctttgcttttgctgcattctattcgttgtgaacacaaattacaggccagtctcgattcagtgtagaagggaactgcataaggaccacataccaggaggcataattcactgggagcatctttagaaactaccagagttacctgttgcccataccagtggggtaagccctatgaatgtatatgagagtttcaaacatccacaaaacattggctttctaatattcgtattcccactattcctttcttttcatgattcatgtcattgtcccatcaacatttctaagatttccattccgttaagagcaaaagagaatgttggaaggtgggggaaaacatttctttgttttctacagggccagcttcttggatgtgtgtgatctgttcagttgcaaagggtcacatgctcagaaggaccgcatgctaaatttaatgctttgcagttaccctcttgaaatcctttattttttaagaaggaattcgacatttccatttttcaatgagccccacaaattacgcagctagtcctgggcttctctactctgaaattgggcaggatctctcttgatctagaatttactaaggcataataggggcaagaaaatcttatgaaataatggggggtagggaagagatgggaatggagcatgagatccagcttcgttattctctacttgagaaaaataaggccccaaagattaaacaacttgcccaaggatattgcttgttagtgtcagaactgaaaccagaaaccaaatgatcatatccctagacttttagtctgctttctcttccataaaatgaaacttataatgtttctaatccattgctcagacaggtagacatgaatattaattgataatgactattaattgatctggaaaatacttgtttggggatcaataatatgtttgggctattatctaatgctgtgtagaaatattaaaacccctgttattttgaaataaaaaagatacccactttt

SEQ ID NO: 94 - DNA, 489 bp, Homo sapiens
agagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaataccatgacattgggtgacattgtcttcaagagaatcagcaagagaatttaaacaagtctgcatttcatattattttagtgtgtaaaattaatgtaataaagtgaactttgtttt

SEQ ID NO: 95 - DNA, 2054 bp, Homo sapiens
gtcgagagcgggagaagtcctgtagggagatgggcagttaccttctctccgtctctctctcggggactctatttgtggctggtggagctgtcttaaacgaagagaaccatgagcaatgaatcttgtttaccttattacacagcccacagctactcttcaatgagtgcgttcaaaacctccatgggggacctgcaacgacaattgtacaacagaggagagtacaacattttcaagtatgcaccaatgttcgagagtaattttattcagataaacaaaaagggagaggtgattgatgtacacaaccgtgtccgaatggtgacagtgggcatcgtctgcaccagccccatcctcccactgcctgacgtcatggttctggcccaaccaactaaaatctgtgaacagcatgtcagatggggccggtttgccaaggggagaggtcgcaggcccgtcaagactctagagctcacgagactgcttcccttgaaatttgtgaagatctccatccacgatcatgagaaacagcagctgcgcctgaaactcgccactggccgtactttttatctgcagttgtgtccctcttctgacacacgggaagatctcttttgctattgggaaaaacttgtctatctcctgaggccaccagtagagagttactgcagtaccccaacacttctatctggggacgcaccacccgaagacaacaaaagcctagtggctgcagagctccacagagaaggggatcagagtgagactgggctctacaagccttgtgatgtatctgcagccacctcttctgcttatgctgggggagagggaatccaacatgcctcccacggaacggctagtgcggcttctccatccacgagcactccaggggctgctgaaggaggagcagcaaggacagcaggtggcatggcagtggcaggaacagcaacaggacctagaacagatgtggcaatagcaggggcagcaatgagtcctgcaacaggtgctatgagcatagcaacaaccaaatctgcaggcccaggccaagtgaccacagcgctggcgggagcagctatcaaaaatccaggagaaaatgaatccagcaagtccatggcaggtgctgccaacatatcctcagagggtattagcttggccttggtgggtgctgcaagcacctccttggaaggtacttccacctcgatggcgggggccgccagtctctcccaagacagcagcttgagtgcggcgtttgcaggcagtattacgaccagcaagtgtgcagcagaaagaactgaaggaccagcagtgggacccctcatctccaccttgcaaagcgaaggctacatgagtgaacgagatggaagccagaaagtttcccagcccagtgctgaagtctggaatgaaaacaaggaaagaagagaaaagaaggacagacatcccagtaggaaaagttctcatcaccgcaaggcaggtgaaagtcaccgcaggagagcgggggacaagaatcagaaagcgtcttcccaccggtccgcatctggccataaaaacacgagagatgacaaaaaagaaaaagggtacagcaacgtaaggggcaagcgacatggctcctctcgcaagagctccacccacagctccaccaaaaaggagtcgagaacaactcaggaactggggaagaaccaatctgcatctagcacaggagctttacaaaagaaagccagtaagatcagctcttttttaaggagcctcagggccactcctggttcaaaaacaagggtcacatcacatgacagagaggtagatatcgtggctaagacggtggagaagcaaaacatagaggccaaagtggagaaagcccagggtggccaggagctggagatgatcagtggcactatgacatccgagaagacggagatgatcgtctttgaaaccaaatccatttaaagaggagccagggctacaaccgcccagggatctggaagtatccctagaggagcccatcccagctttctttactgcagttcaaataataaaggaaatcgtacaactccaaaagaaaaaaaaaaaaaaaa

SEQ ID NO: 96 - DNA, 15020 bp, Homo sapiens
ggagttttccaccatgactattgccctgctgggttttgccatattcttgctccattgtgcgacctgtgagaagcctctagaagggattctctcctcctctgcttggcacttcacacactcccattacaatgccaccatctatgaaaattcttctcccaagacctatgtggagagcttcgagaaaatgggcatctacctcgcggagccacagtgggcagtgaggtaccggatcatctctggggatgtggccaatgtatttaaaactgaggagtatgtggtgggcaacttctgcttcctaagaataaggacaaagagcagcaacacagctcttctgaacagagaggtgcgagacagctacaccctcatcatccaagccacagagaagaccttggagttggaagctttgacccgtgtggtggtccacatcctggaccagaatgacctgaagcctctcttctctccaccttcgtacagagtcaccatctctgaggacatgcccctgaagagccccatctgcaaggtgactgccacagatgctgatctaggccagaatgctgagttctattatgcctttaacacaaggtcagagatgtttgccatccatcccaccagcggtgtggtcactgtggctgggaagcttaacgtcacctggcgaggaaagcatgagctccaggtgctagctgtggaccgcatgcggaaaatctctgagggcaatgggtttggcagcctggctgcacttgtggttcatgtggagcctgccctcaggaagcccccagccattgcttcggtggtggtgactccaccagacagcaatgatggtaccacctatgccactgtactggtcgatgcaaatagctcaggagctgaagtggagtcagtggaagttgttggtggtgaccctggaaagcacttcaaagccatcaagtcttatgcccggagcaatgagttcagtttggtgtctgtcaaagacatcaactggatggagtaccttcatgggttcaacctcagcctccaggccaggagtgggagcggcccttatttttattcccagatcaggggctttcacctaccaccttccaaactgtcttccctcaaattcgagaaggctgtttacagagtgcagcttagtgagttttcccctcctggcagccgcgtggtgatggtgagagtcaccccagccttccccaacctgcagtatgttctaaagccatcttcagagaatgtaggatttaaacttaatgctcgaactgggttgatcaccaccacaaagctcatggacttccacgacagagcccactatcagctacacatcagaacctcaccgggccaggcctccaccgtggtggtcattgacattgtggactgcaacaaccatgcccccctcttcaacaggtcttcctatgatggtaccttggatgagaacatccctccaggcaccagtgttttggctgtgactgccactgaccgggatcatggggaaaatggatatgtcacctattccattgctggaccaaaagctttgccattttctattgacccttacctggggatcatctccacctccaaacccatggactatgaactcatgaaaagaatttataccttccgggtaagagcatcagactggggatccccttttcgccgggagaaggaagtgtccatttttcttcagctcaggaacttgaatgacaaccagcctatgtttgaagaagtcaactgtacagggtctatccgccaagactggccagtagggaaatcgataatgactatgtcagccatagatgtggatgagcttcagaacctaaaatacgagattgtatcaggcaatgaactagagtattttgatctaaatcatttctccggagtgatatccctcaaacgcccttttatcaatcttactgctggtcaacccaccagttattccctgaagattacagcctcagatggcaaaaactatgcctcacccacaactttgaatattactgtggtgaaggaccctcattttgaagttcctgtaacatgtgataaaacaggggtattgacacaattcacaaagactatcctccactttattgggcttcagaaccaggagtccagtgatgaggaattcacttctttaagcacatatcagattaatcattacaccccacagtttgaggaccacttcccccaatccattgatgtccttgagagtgtccctatcaacacccccttggcccgcctagcagccactgaccctgatgctggttttaatggcaaactggtctatgtgattgcagatggcaatgaggagggctgctttgacatagagctggagacagggctgctcactgtagctgctcccttggactatgaagccaccaatttctacatcctcaatgtaacagtatatgacctgggcacaccccagaagtcctcctggaagctgctgacagtgaatgtgaaagactggaatgacaacgcacccagatttcctcccggtgggtaccagttaaccatctcggaggacacagaagttggaaccacaattgcagagctgacaaccaaagatgctgactcggaagacaatggcagggttcgctacaccctgctaagtcccacagagaagttctccctccaccctctcactggggaactggttgttacaggacacctggaccgcgaatcagagcctcggtacatactcaaggtggaggccagggatcagcccagcaaaggccaccagctcttctctgtcactgacctgataatcacattggaggatgtcaacgacaactctccccagtgcatcacagaacacaacaggttgaaggttccagaggacctgccccccgggactgtcttgacatttctggatgcctctgatcctgacctgggccccgcaggtgaagtgcgatatgttctgatggatggcgcccatgggaccttccgggtggacctgatgacaggggcgctcattctggagagagagctggactttgagaggcgagctgggtacaatctgagcctgtgggccagtgatggtgggaggcccctagcccgcaggactctctgccatgtggaggtgatcgtcctggatgtgaatgagaatctccaccctccccactttgcctccttcgtgcaccagggccaggtgcaggagaacagcccctcgggaactcaggtgattgtagtggctgcccaggacgatgacagtggcttggatggggagctccagtacttcctgcgtgctggcactggactcgcagccttcagcatcaaccaagatacaggaatgattcagactctggcacccctggaccgagaatttgcatcttactactggttgacggtattagcagtggacaggggttctgtgcccctctcttctgtaactgaagtctacatcgaggttacggatgccaatgacaacccaccccagatgtcccaagctgtgttctacccctccatccaggaggatgctcccgtgggcacctctgtgcttcaactggatgcctgggacccagactccagctccaaagggaagctgaccttcaacatcaccagtgggaaccacatgggattctttatgattcaccctgttacaggtctcctatctacagcccagcagctggacagagagaacaaggatgaacacatcctggaggtgactgtgctggacaatggggaaccctcactgaagtccacctccagggtggtggtaggcatcttggacgtcaatgacaatccacctatattctcccacaagctcttcaatgtccgccttccagagaggctgagccctgtgtcccctgggcctgtgtacaggctggtggcttcagacctggatgagggtcttaatggcagagtcacctacagtatcgaggacagcgatgaggaggccttcagtatcgacctggtcacaggtgtggtttcatccagcagcacttttacagctggagagtacaacatcctaacgatcaaggcaacagacagtgggcagccaccactctcagccagtgtccggctacacattgagtggatcccttggccccggccgtcctccatccctctggcctttgatgagacctactacagctttacggtcatggagacggaccctgtgaaccacatggtgggggtcatcagcgtagagggcagacccggactcttctggttcaacatctcaggtggggataaggacatggactttgacattgagaagaccacaggcagcatcgtcattgccaggcctcttgataccaggagaaggtcgaactataacttgactgttgaggtgacagatgggtcccgcaccattgccacacaggtccacatcttcatgattgccaacattaaccaccatcggccccagtttctggaaactcgttatgaagtcagagttccccaggacaccgtgccaggggtagagctcctgcgagtccaggccatagatcaagacaagggcaaaagcctcatctataccatacatggcagccaagacccaggaagtgccagcctcttccagctggacccaagcagtggtgtcctggtaacggtgggaaaattggacctcggctcggggccctcccagcacacactgacagtcatggtccgagaccaggaaatacctatcaagaggaacttcgtgtgggtgaccattcatgtggaggatggaaacctccacccaccccgcttcactcagctccattatgaggcaagtgttcctgacaccatagcccccggcacagagctgctgcaggtccgagccatggatgctgaccggggagtcaatgctgaggtccactactccctcctgaaagggaacagcgaaggtttcttcaacatcaatgccctgctaggcatcattactctagctcaaaagcttgatcaggcaaatcatgccccacatactctgacagtgaaggcagaagatcaaggctccccacaatggcatgacctggctacagtgatcattcatgtctatccctcagataggagtgcccccatcttttcaaaatctgagtactttgtagagatccctgaatcaatccctgttggttccccaatcctccttgtctctgctatgagcccctctgaagttacctatgagttaagagagggaaataaggatggagtcttctctatgaactcatattctggccttatttccacccagaagaaattggaccatgagaaaatctcgtcttaccagctgaaaatccgaggcagcaatatggcaggtgcatttactgatgtcatggtggtggttgacataattgatgaaaatgacaatgctcctatgttcttaaagtcaacttttgtgggccaaattagtgaagcagctccactgtatagcatgatcatggataaaaacaacaacccctttgtgattcatgcctctgacagtgacaaagaagctaattccttgttggtctataaaattttggagccggaggccttgaagtttttcaaaattgatcccagcatgggaaccctaaccattgtatcagagatggattatgagagcatgccctctttccaattctgtgtctatgtccatgaccaaggaagccctgtattatttgcacccagacctgcccaagtcatcattcatgtcagagatgtgaatgattcccctcccagattctcagaacagatatatgaggtagcaatagtcgggcctatccatccaggcatggagcttctcatggtgcgggccagcgatgaagactcagaagtcaattatagcatcaaaactggcaatgctgatgaagctgttaccatccatcctgtcactggtagcatatctgtgctgaatcctgctttcctgggactctctcggaagctcaccatcagggcttctgatggcttgtatcaagacactgcgctggtaaaaatttctttgacccaagtgcttgacaaaagcttgcagtttgatcaggatgtctactgggcagctgtgaaggagaacttgcaggacagaaaggcactggtgattcttggtgcccagggcaatcatttgaatgacaccctttcctactttctcttgaatggcacagatatgtttcatatggtccagtcagcaggtgtgttgcagacaagaggtgtggcgtttgaccgggagcagcaggacactcatgagttggcagtggaagtgagggacaatcggacacctcagcgggtggctcagggtttggtcagagtctctattgaggatgtcaatgacaatccccccaaatttaagcatctgccctattacacaatcatccaagatggcacagagccaggggatgtcctctttcaggtatctgccactgatgaggacttggggacaaatggggctgttacatatgaatttgcagaagattacacatatttccgaattgacccctatcttggggacatatcactcaagaaaccctttgattatcaagctttaaataaatatcacctcaaagtcattgctcgggatggaggaacgccatccctccagagtgaggaagaggtacttgtcactgtgagaaataaatccaacccactgtttcagagtccttattacaaagtcagagtacctgaaaatatcaccctctataccccaattctccacacccaggcccggagtccagagggactccggctcatctacaacattgtggaggaagaacccttgatgctgttcaccactgacttcaagactggtgtcctaacagtaacagggcctttggactatgagtccaagaccaaacatgtgttcacagtcagagccacggatacagctctggggtcattttctgaagccacagtggaagtcctagtggaggatgtcaatgataaccctcccactttttcccaattggtctataccacttccatctcagaaggcttgcctgctcagacccctgtgatccaactgttggcttctgaccaggactcagggcggaaccgtgacgtctcttatcagattgtggaggatggctcagatgtttccaagttcttccagatcaatgggagcacaggggagatgtccacagttcaagaactggattatgaagcccaacaacactttcatgtgaaagtcagggccatggataaaggagatcccccactcactggtgaaacccttgtggttgtcaatgtgtctgatatcaatgacaaccccccagagttcagacaacctcaatatgaagccaatgtcagtgaactggcaacctgtggacacctggttcttaaagtccaggctattgaccctgacagcagagacacctcccgcctggagtacctgattctttctggcaatcaggacaggcacttctccattaacagctcatcgggaataatttctatgttcaacctttgcaaaaagcacctggactcttcttacaatttgagggtaggtgcttctgatggagtcttccgagcaactgtgcctgtgtacatcaacactacaaatgccaacaagtacagcccagagttccagcagcacctttatgaggcagaattagcagagaatgcaatggttggaaccaaggtgattgatttgctagccatagacaaagatagtggtccctatggcactatagattatactatcatcaataaactagcaagtgagaagttctccataaaccccaatggccagattgccactctgcagaaactggatcgggaaaattcaacagagagagtcattgctattaaggtcatggctcgggatggaggaggaagagtagccttctgcacggtgaagatcatcctcacagatgaaaatgacaaccccccacagttcaaagcatctgagtacacagtatccattcaatccaatgtcagtaaagactctccggttatccaggtgttggcctatgatgcagatgaaggtcagaacgcagatgtcacctactcagtgaacccagaggacctagttaaagatgtcattgaaattaacccagtcactggtgtggtcaaggtgaaagacagcctggtgggattggaaaatcagacccttgacttcttcatcaaagcccaagatggaggccctcctcactggaactctctggtgccagtacgacttcaggtggttcctaaaaaagtatccttaccgaaattttctgaacctttgtatactttctctgcacctgaagaccttccagaggggtctgaaattgggattgttaaagcagtggcagctcaagatccagtcatctacagtctagtgcggggcactacacctgagagcaacaaggatggtgtcttctccctagacccagacacaggggtcataaaggtgaggaagcccatggaccacgaatccaccaaattgtaccagattgatgtgatggcacattgccttcagaacactgatgtggtgtccttggtctctgtcaacatccaagtgggagacgtcaatgacaataggcctgtatttgaggctgatccatataaggctgtcctcactgagaatatgccagtggggacctcagtcattcaagtgactgccattgacaaggacactgggagagatggccaggtgagctacaggctgtctgcagaccctggtagcaatgtccatgagctctttgccattgacagtgagagtggttggatcaccacactccaggaacttgactgtgagacctgccagacttatcattttcatgtggtggcctatgaccacggacagaccatccagctatcctctcaggccctggttcaggtctccattacagatgagaatgacaatgctccccgatttgcttctgaagagtacagaggatctgtggttgagaacagtgagcctggcgaactggtggcgactctaaagaccctggatgctgacatttctgagcagaacaggcaggtcacctgctacatcacagagggagaccccctgggccagtttggcatcagccaagttggagatgagtggaggatttcctcaaggaagaccctggaccgcgagcatacagccaagtacttgctcagagtcacagcatctgatggcaagttccaggcttcggtcactgtggagatctttgtcctggacgtcaatgataacagcccacagtgttcacagcttctctatactggcaaggttcatgaagatgtatttccaggacacttcattttgaaggtttctgccacagacttggacactgataccaatgctcagatcacatattctctgcatggccctggggcgcatgaattcaagctggatcctcatacaggggagctgaccacactcactgccctagaccgagaaaggaaggatgtgttcaaccttgttgccaaggcgacggatggaggtggccgatcgtgccaggcagacatcaccctccatgtggaggatgtgaatgacaatgccccgcggttcttccccagccactgtgctgtggctgtcttcgacaacaccacagtgaagacccctgtggctgtagtatttgcccgggatcccgaccaaggcgccaatgcccaggtggtttactctctgccggattcagccgaaggccacttttccatcgacgccaccacgggggtgatccgcctggaaaagccgctgcaggtcaggccccaggcaccactggagctcacggtccgtgcctctgacctgggcaccccaataccgctgtccacgctgggcaccgtcacagtctcggtggtgggcctagaagactacctgcccgtgttcctgaacaccgagcacagcgtgcaggtgcccgaggacgccccacctggcacggaggtgctgcagctggccaccctcactcgcccgggcgcagagaagaccggctaccgcgtggtcagcgggaacgagcaaggcaggttccgcctggatgctcgcacagggatcctgtatgtcaacgcaagcctggactttgagacaagccccaagtacttcctgtccattgagtgcagccggaagagctcctcttccctcagtgacgtgaccacagtcatggtcaacatcactgatgtcaatgaacaccggccccaattcccccaagatccatatagcacaagggtcttagagaatgcccttgtgggtgacgtcatcctcacggtatcagcgactgatgaagatggacccctaaatagtgacattacctatagcctcataggagggaaccagcttgggcacttcaccattcaccccaaaaagggggagctacaggtggccaaggccctggaccgggaacaggcctctagttattccctgaagctccgagccacagacagtgggcagcctccactgcatgaggacacagacatcgctatccaagtggctgatgtcaatgataacccaccgagattcttccagctcaactacagcaccactgtccaggagaactcccccattggcagcaaagtcctgcagctgatcctgagtgacccagattctccagagaatggccccccctactcgtttcgaatcaccaaggggaacaacggctctgccttccgagtgaccccggatggatggctggtgactgctgagggcctaagcaggagggctcaggaatggtatcagcttcagatccaggcgtcagacagtggcatccctcccctctcgtcttcgacgtctgtccgtgtccatgtcacagagcagagccactatgcaccttctgctctcccactggagatcttcatcactgttggagaggatgagttccagggtggcatggtgggtaagatccatgccacagaccgagacccccaggacacgctgacctatagcctggcagaagaggagaccctgggcaggcacttctcagtgggtgcgcctgatggcaagattatcgccgcccagggcctgcctcgtggccactactcgttcaacgtcacggtcagcgatgggaccttcaccacgactgctggggtccatgtgtatgtgtggcatgtggggcaggaggctctgcagcaggccatatggatgggcttctaccagctcacccccgaggagctggtgagtgaccactggcggaacctgcagaggttcctcagccataagctggacatcaaacgggctaacattcacttggccagcctccagcctgcagaggccgtggctggtgtggacgtgctcctggtctttgaggggcattctggaaccttctacgagtttcaggagctagcatccatcatcactcactcagccaaggagatggagcattcagtgggggttcagatgcggtcagctatgcccatggtgccctgccaggggccaacctgccagggtcaaatctgccataacacagtgcatctggaccccaaggttgggcccacgtacagcaccgccaggctcagcatcctaaccccgcggcaccacctgcagaggagctgctcctgcaatggtactgctacaaggttcagtggtcagagctatgtgcggtacagggccccagcggctcggaactggcacatccatttctatctgaaaacactccagccacaggccattcttctattcaccaatgaaacagcgtccgtctccctgaagctggccagtggagtgccccagctggaataccactgtctgggtggtttctatggaaacctttcctcccagcgccatgtgaatgaccacgagtggcactccatcctggtggaggagatggacgcttccattcgcctgatggttgacagcatgggcaacacctcccttgtggtcccagagaactgccgtggtctgaggcccgaaaggcacctcttgctgggcggcctcattctgttgcattcttcctcgaatgtctcccagggctttgaaggctgcctggatgctgtcgtggtcaacgaagaggctctagatctgctggcccctggcaagacggtggcaggcttgctggagacacaagccctcacccagtgctgcctccacagtgactactgcagccagaacacatgcctcaatggtgggaagtgctcatggacccatggggcaggctatgtctgcaaatgtcccccacagttctctgggaagcactgtgaacaaggaagggagaactgtacttttgcaccctgcctggaaggtggaacttgcatcctctcccccaaaggagcttcctgtaactgccctcatccttacacaggagacaggtgtgaaatggaggcgaggggttgttcagaaggacactgcctagtcactcccgagatccaaaggggggactgggggcagcaggagttactgatcatcacagtggccgtggcgttcattatcataagcactgtcgggcttctcttctactgccgccgttgcaagtctcacaagcctgtggccatggaggacccagacctcctggccaggagtgttggtgttgacacccaagccatgcctgccatcgagctcaacccattgagtgccagctcctgcaacaacctcaaccaactggaacccagcaaggcctctgttccaaatgaactcgtcacatttggacccaattctaagcaacggccagtggtctgcagtgtgccccccagactcccgccagctgcggtcccttcccactctgacaatgagcctgtcattaagagaacctggtccagtgaggagatggtgtaccctggcggagccatggtctggccccctacttactccaggaacgaacgctgggaatacccccactccgaagtgactcagggccctctgccgccctcggctcaccgccactcaaccccagtcgtgatgccagagcctaatggcctctatgggggcttccccttccccctggagatggaaaacaagcgggcacctctcccaccccgttacagcaaccagaacctggaagatctgatgccctctcggccccctagtccccgggagcgcctggttgccccctgtctcaatgagtacacggccatcagctactaccactcgcagttccggcagggagggggagggccctgcctggcagacgggggctacaagggggtgggtatgcgcctcagccgagctgggccctcttatgctgtctgtgaggtggagggggcacctcttgcaggccagggccagccccgggtgccccccaactatgagggctctgacatggtggagagtgattatggcagctgtgaggaggtcatgttctagcttcccattcccagagcaaggcaggcgggaggccaaggactggacttggcttatttcttcctgtctcgtagggggtgagttgagtgtggctgggagagtgggagggaagccctcagcccaggctgttgtcccttgaaatgtgctcttccaatcccccacctagtccctgagggtggagggaagctgaggatagagctccagaaacagcactagggtcccaggagaggggcatttctagagcagtgaccctggaaaaccaggaacaattgactcccggggtgggcgagagacaggagggctccctgatctgccggctctcagtccccggggcagagcctgattgactgtgctggctcaacttcaccaagatgcattctcatacctgcccacagctccattttggaggcaggcaggttggtgcctgacagacaaccactacgcgggccgtacagaggagctctagagggctgcgtggcatcctcctaggggctgagaggtgagcagcaggggagcgggcacagtcccctctgcccctgcctcagtcgagcactcactgtgtctttgtcaagtgtctgctccacgtcaggcactgtgctttgcaccggggagaaaatggtgatggagggcaacaaggactccgaggagcaccaccaggcctcgggccccagaggtcccactcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccattgcagacgcctgcccatcaagtattacctgcggcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgagtggtttgtggctgtgtgtgtgactgtgagtgtgagtgacagatacatagtttcattggtcattttttttttaacaataaagtatctttttttactgttattttctgtgtcctttagcctgtttggggtcaggggaacgatgcaagggtccacaggccgttccaagattcatggattttgggagctggaagggatcctagagattgtcaagcaacagagattcccaacctggcaacattacctatcccagacacaaaaccagaacttctgggggtggggcccaggaaactatttggaaaaaaccctctgcctctgatacaactgtctgcagtggttcaagcccctccatttagatggggctctggggctctgaggctctgagtgatgagtccactaactagcaggctagctaaagcccaggacaagacctggggcttcctgcccttgccagcactctttgcactgcatggcattagttacggagaagggacttaactatcagaagtcttgggaagctggccctcctgggacccagagtcagcctctggctgctactccacagcgcacccttagtcgccagctaa

SEQ ID NO: 97 - DNA, 570 bp, Homo sapiens
agcagtgacgtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaa

SEQ ID NO: 98 - DNA, 2947 bp, Homo sapiens
ctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgctccagcaggagaagacagacacggtccgctgcatcaagtcctgccgccccaacgatgtcacatgcgtgttcgaccccgtgcacaccatctcccacaccgtcatctcgctgcctaccttccgcgagttcacccgccctgaagagatcatcttcctccgggccatcacgccaccgcatcctgccagccaggctaacatcatcttcgacatcacggaagggaacctgcgggactcttttgacatcatcaagcgttacatggacggcatgaccgtgggtgtcgtgcgccaggtgcggcccatcgtgggcccatttcatgccgtcctgaagctggagatgaactatgtggtcgggggcgtggtctcccaccgaaatgttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcactttttttttttttttggccaatcagattttctatgttctaaggacatggctgctgtagaatagcacagacgtggatgataaattatccccagaagcagcatgacagaatgcctcggggagcacttggaagggaaattgcagttctgttgaaatagaggaaaatcccttggtaaagacacagcctgttaggctcgtgtgggcctccagtatgttcaccaggggaatggctgggatttctcggcactctgcatcatccatcttttcttataggtgggaaaataaacaactttgtgatcctcctg

SEQ ID NO: 99 - DNA, 1671 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccagg

SEQ ID NO: 100 - DNA, 1605 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccagg

SEQ ID NO: 101 - DNA, 1383 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccagg

SEQ ID NO: 102 - DNA, 1635 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccagg

SEQ ID NO: 103 - DNA, 1347 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccagg

SEQ ID NO: 104 - DNA, 1561 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccagg

SEQ ID NO: 105 - DNA, 1569 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccagg

SEQ ID NO: 106 - DNA, 1636 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggttcaagcaattctcctgcctcagcctcctgagtagctgggaccacacagacagggtttcaccatgttggccaggctggtctcgaactcccgacctcaggtgatccacctgcctcggcctcccaaagtgctgggattacaggcgtgagccaccgcgcctggccaggctgcacacattcttattaggattccaccttgttctggtgttgtagagatgtgattaggtatttagtgaattcaccaagtgaggagagaatgaaaagaaaacacaacctgcctggccgggcgtggtggcgtgagcctgtcgtcccagctactcaggaggctgaggcaggagaatcacttgaacccaggaggcagctgttgcagtgagccaagatcacgccattgcactccagcctgggtgacagaacgagactccacctcaagaaaaaaaaaaaaaa

SEQ ID NO: 107 - DNA, 9463 bp, Homo sapiens
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 108 - DNA, 8449 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 109 - DNA, 2402 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactgaaaaaaaaaaaaaaaaaaaa

SEQ ID NO: 110 - DNA, 7912 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 111 - DNA, 8647 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 112 - DNA, 8272 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 113 - DNA, 8374 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 114 - DNA, 8815 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 115 - DNA, 5198 bp, Homo sapiens
tcttcccctccgccgcggcccgccccggcccgcaaacccaaacactccaggcgcccgcccgccgcgcgtgattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggttacaggaggttccagtggcatcgggaagtgcattgctatcgagtgctataaacaaggagcttttataactctggttgcacgaaatgaggataagctgctgcaggcaaagaaagaaattgaaatgcactctattaatgacaaacaggtggtgctttgcatatcagttgatgtatctcaagactataaccaagtagagaatgtcataaaacaagcacaggagaaactgggtccagtggacatgctggtaaattgtgcaggaatggcagtgtcaggaaaatttgaagatcttgaagttagtacctttgaaaggttaatgagcatcaattacctgggcagcgtgtaccccagccgggccgtgatcaccaccatgaaggagcgccgggtgggcaggatcgtgtttgtgtcctcccaggcaggacagttgggattattcggtttcacagcctactctgcatccaagtttgccataaggggattggcagaagctttgcagatggaggtgaagccatataatgtctacatcacagttgcttacccaccagacacagacacacctggctttgccgaagaaaacagaacaaagcctttggagactcgacttatttcagagaccacatctgtgtgcaaaccagaacaggtggccaaacaaattgttaaagatgccatacaaggaaatttcaacagttcccttggctcagatgggtacatgctctcggccctgacctgtgggatggctccagtaacttctattactgaggggctccagcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctctctctctgtctctctgtctctctgtctctctgtctctctgtctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaaaatctagaagcttaagaatttacagttccttcaataaccatgatgacctgaagttcacctatcccattttagcatctacttgtttttcccatctcttcctttccaattttgcttatactgctgtaatatttttgtaaaaaaaaaaaaaaaggaaaaaaaagaccagctaaaattttcgacttgactttttaacttaactcatgaattaattaaagcaaatgaaaaaattaaaaagtgtgactttttctcggagcatatatgtagcttttaggaaaggctgatgatggtataaagtttgctcattaagaaaaaaagacaaggctgattttgaagagagttgcttttgaaataaaatgatcacctgttctttatgtgactctcccactgaacctgcagacattatttttataccacatgctaaggaagcccactcatctaactctgtagccctggaaaccctcttggcccctgaatgttgtttccaggttataggatctgtgttcattagtggattttgacagcaagtgcctctgatgagttttagccaacattccccgttgcatcctgctcattgttcacactcctctgacttgaggagagctgccttcaccttgatcttgtaacctgtcttccttgcatatacggtagcacattccagatcacttcggtgagaaaagacctctgtttttgaagaggaaactttcttaaattgtaaaataaaacttaaaaaacataaaaactctatacaaaaattgaagacctaaaaattatagcataccttttttttgctcttgagtttttgaagctcttgactttaaatgacttaactttttaaaaaataagatgttttatggctttaacccatgtttttattaagatctgagaatagcatattttaaacactgatagatacagaagaaattattatttaatatataaattgcttggaatgatttcattgcagcttgtaaggatgggttgatgccagaatggtttcataaatctttcagtcttacagagccaaagtttgcagattatatcgagttgcgttgtgcagctgctaaaatggaatcatagctttttataatttgcagaaaacaattgcattaatgtctggatgtttctcagttttattcttttctcataaatgttcctcgaatgttggcaccttctactgctgatctatattagaatctagtccaagaaagtgtctgatttaataacattaaatagttatttcaatatattttttcaaattatcctcatagaacctgttgcctccagtgagatggtaatctactacccgaataaatttaagagcacctgttgagagcccctgttttgcggtagaagacaattgtccctatcccaatttccactgaaatatgagagcagatttgcagagaccatcatgtcagagaagaaatttccttgtcagagatgttaaagggctacagtcccttagcaaagaaacttcgaaatctaagttggtttgtgtttttctaaatttgataccgtaattcatttggcagcaaaatctgacttgaactgatgtgagagtattgtactttatatttatgctacttcattgtgacttaattttccctgaagaaatatccatggatttgattataggttttcccttagatgctgtggaggtgttttgtaatattcaaaatatgcccatattgcctttttaaaaccccaaagattatgaattctgaaacacatccagcccagcgggttttggataaggggttgtaggcatttaagcagcctcacataatgggctgacttcatccaaaacatgaaaatattacaaggcaaattctattttttatattttttggttcaatgcttgaacaacttgtttttctgctgggggaagaaaaaaagaaccaaccctgagtgtgattgttacggaaactaatgactttgtttttaaaggatcacattgattcaacaccttctattggacccagaagtgcgtaaatattacctatggtagtaaacgtttaattatcattcagtttaaatgttggccttctgtatgtagccaagaacagctcattttgtgaatttcagtttttaagtggctgctttttgatttggttgtattattttattataatgtatttgcaagtatattaaaaaattaacattgagccataaaaatccccaaatatgttcaaggacttcataattgaaaaatatatagaaaacaatccttacttctttttacaaaaacaaaatcatgggaattattcttttctatatatttagttataaatctttctctgggccgggcgtggtggctcacgccagtaatcccagcactttgggaggctgagacaggcgaatcacgaggtcaggagttcgagaccagcctggccaacatggtgaaaccccgtctctactgaaaatacaaaaaattagctggacacggtggcaggcgcctgtgtgtggcgggcgccagctactcaggaggctgaggcaggagaatcgcttgaacccaggaggcagaggttgcagtgagccaagattgcgccactgcactccagcctaggtgacagtgcgagactctgtctcaaaaaaaaaaaaaaagaaaaaaaatctttatctggatctgttaaaccatatattattgatcattgcaagtgaaattttgagagattgtttctagtatttaggtgatgaaaacatttggtaatattgctttggttcaaagaattttatgtctttatctttctagaagaaagcaattatatatatatttttgctaaattacataaacatttaattacatcaggttctaatttaaacatgtattactcacttgaggccacttttaaatattcatactctttgacataagatgctttgtatatttctcatttcttttagttcttagtaagtcagctttaaaaagtacctgccaaccagaaccttccatattctggactaaatcttgctcttcggattatacttcagtgcagtaactgtggatttgcaattttgaaggggagatagtagctattatattttacacttgcttgatgtgataactctaaagactttttaactgataaaagcgcacatggctattttgatacacaaagttgtgtttgctactttagaagcttttgtggcagaattgtaatctaattttcataccttgtatttctgaatcacaacaaaaaaataaatggggaacaagactta

SEQ ID NO: 116 - DNA, 2262 bp, Homo sapiens
cacatacccaactgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacatattcacatacgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaat

SEQ ID NO: 117 - DNA, 2270 bp, Homo sapiens
cacatacccaactgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccaggtatgtagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacatattcacatacgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaat

SEQ ID NO: 118 - DNA, 4185 bp, Homo sapiens
atgacaatggaatcggtacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcacctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaatgcctctttaataaactacctctaacactatttctgcagtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcgtgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaaaaaaaaaaaa

SEQ ID NO: 119 - DNA, 1640 bp, Homo sapiens
atgacaatggaatcggtacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatggtaaacttttgttgttgctattggattaactcacttctttactattggaaaaataaaatataaaactgaaaaaaaaaaaa

SEQ ID NO: 120 - DNA, 4713 bp, Homo sapiens
ggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagccaaaaaaaaaaaaaaaaaaaaaaaaaaaaaaaaaaa

SEQ ID NO: 121 - DNA, 2324 bp, Homo sapiens
acatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaaaaaaaaaaaaaa

SEQ ID NO: 122 - DNA, 2432 bp, Homo sapiens
cttttccaatccaggtcccgccccgactccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaaaaaaaaaaaa

SEQ ID NO: 123 - DNA, 2413 bp, Homo sapiens
cttttccaatccaggtcccgccccgactccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaaaaaaaaaaaa

SEQ ID NO: 124 - DNA, 2571 bp, Homo sapiens
cttttccaatccaggtcccgccccgactccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgtagagacggggtttcaccatgttggtcaggctggtctccaattcctgacctcgtgatccgcccgcctcggcctgccaaacagctgtgattataggcgtgagccaccgcgcccggccaaccatcattattatttttaacgtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaaaaaaaaaaaa

SEQ ID NO: 125 - DNA, 2568 bp, Homo sapiens
cttttccaatccaggtcccgccccgactccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgagacggggtttcaccatgttggtcaggctggtctccaattcctgacctcgtgatccgcccgcctcggcctgccaaacagctgtgattataggcgtgagccaccgcgcccggccaaccatcattattatttttaacgtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaaaaaaaaaaaa

SEQ ID NO: 126 - DNA, 1220 bp, Homo sapiens
agtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcggaggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttaaaaaaaaaaaaaaaaaaaa

SEQ ID NO: 127 - DNA, 1710 bp, Homo sapiens
cagcagggctcccgcgggcgtcactccggccatcgtccccacctccacctgggccgcccggcaggcaggcgacggaggcccgggagccatgggtgactggggcttcctggagaagttgctggaccaggtccaggagcactcgaccgtggtgggtaagatctggctgacggtgctcttcatcttccgcatcctcatcctgggcctggccggcgagtcagtgtggggtgacgagcaatcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctgcggcagaaggagggggagctgcgggcactgccggccaaggacccacaggtggagcgggcgctggcggccgtagagcgtcagatggccaagatctcggtggcagaagatggtcgcctgcgcatccgcggagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccaggtcttcttctacctccccgtgggccaggggccctcatccccaccatgccccacctacaatgggctctcatccagtgagcagaactgggccaacctgaccacagaggagaggctggcgtcttccaggccccctctcttcctggacccaccccctcagaatggccaaaaacccccaagtcgtcccagcagctctgcttctaagaagcagtatgtatagaggcctgtggcttatgtcacccaacagaggggtcctgagaagtctggctgcctgggatgccccctgccccctcctggaaggctctgcagagatgactgggctggggaagcaggtgcttgctggccatggagcctcattgcaagttgttcttgaacacctgaggccttcctggtgcccaccaggcactacggcttcctctccagaatgtggctttgcctgagcacagacagagtcagcatggaatgctcttggccaagggtactgggggccctctggccttttgcagctgatccagaggaacccagagccaacttaccccaacctcaccctatggaacagtcacctgtgcgcaggttgtcctcaaaccctctcctcacaggaaaaggcggattgaggctgctgggtcagccttgatcgcacagacagagcttgtgccggatttggccctgtcaaggggactggtgccttgttttcatcactccttcctagttctactgttcaagcttctgaaataaacaggacttgatcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 128 - DNA, 2220 bp, Homo sapiens
aaccggaaggggggctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggtggggtccctgctgggggacagagagaaggcctcttgttttagcctcatccaacagtttagtaactgtgtttatattttgattacgtgtcctcaaattgtgatattttgatgacaagacagagcccttgagtttgggatcctttctgttggagttgagttattgtgagcctgaaagtacccagttcctttgccagtgcttgaaacaaaccatgaagtggcctctcttaggatccaggtcttttcccatttactgaacttatcatgaaagtgagtgctactacgaggggtccaatcacaggctgagaaattgtgttacagaatctactcttggaagaatgaagacgtggctgtcctttggtacctcgctttaaggtggctttcccttaggacccctactgtggactgccttataactaaaaccttttgtattttagtaactgaatccccactgtgcagtgttagggctgcctggttgtttgcagtagattagagctttagaagcttctagagcttctaaagcccgtgctggtgatcccagcgactcttcactccctagccttaggtattcctagaagccctgaccagttggcactgctgagactccagcccctgggagtggtttacagaaacattacacagactctgatgtcagtcatgatgtttcagcctctgcccttttcctgtatcaaccctgatggataatagggcgtgggttctgtctgttatcagggtgtggtcccctgtgaatgaagcactcccagccactgagctgtgagaaacagtcactcggaagtgtgagctttatcttagtttttgttggatcatgttgagtctgtcagctccacaggacttcagtacgtttctgaacagtccctgccatctctacgggggagagggtcaggcaagctgcaagtgacactcacctcctgctgacagttgcagtgtctcagatggcctggaagggtggtctccagcagcctgctgggcgctcccctttcatgagagccacctgcagtgacctgaactgatacatgttgattagtctgccctttctttagaaaactgctactctccttttcatatctcagaaaaacagtagaggccttttaggaccaaactccatgtcacactgatgaagagccagtgggggttagagcgtcctgttaaggcacatgctaacttcccactcaagtctggcagcgctggggcatcagcacacctcttgccacccacactgataccagaggggaaggctgtgaggtggctgggggttgagacttgaggtttctaactttcctctgcacacctgtggctacctggtgtttgtctcttgattccctccacctgcctcacaccctgcctccgtcgggattttccacctacaccattcaaaaggaacataggagagggcatgaaggggctaggctgaagcactctgatgactggggccaatttgtggctgaaaatgaatacattttttgaaatttatggtcattttcaagtgatttagaaggttgatccttagcctcatacagtgatgaaataatctgtgtgttcagagccaagcaggactttagcaagagtctgattgtattgtcactatctcggggaaaaaaaaatacaaatacatttctctgatctctgatggcaatgaagtttgacttgtaa

SEQ ID NO: 129 - DNA, 3319 bp, Homo sapiens
aaccggaaggggggctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacatagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcctacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatca

SEQ ID NO: 130 - DNA, 1469 bp, Homo sapiens
aaccggaaggggggctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatca

SEQ ID NO: 131 - DNA, 2797 bp, Homo sapiens
gtttgcgtttgaacctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggtgaggcggcggcggaggcgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgcggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcggcctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaatagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgtctgcttttggaccaaaaccagggcttccttcagtttccacaagaagaaaattgtgactgatgtgtcagaggtctgcagcatctataccactgccacttctctctctggatccctcctatcagaatgttcaaaccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcagtcagaagggtcctgtcccctttagccattgccttcccacagaaaaactgcaacgctgtgagaagattggggaaggggtgtttggcgaagtgtttcaaacaattgctgatcacacacccgtagccataaaaatcattgctattgaaggaccagatttagtcaatggatcccatcagaaaacctttgaggaaatcctgccagagatcatcatctccaaagagttgagcctcttatccggtgaagtgtgcaaccgcacagaaggctttatcgggctgaactcagtgcactgtgtccagggatcttaccctcccttgctcctcaaagcctgggatcactataattcaaccaaaggctctgcaaatgaccggcctgatttttttaaagacgaccagctcttcattgtgctggaatttgagtttggagggattgacttagagcaaatgcgaaccaagttgtcttccttggctactgcaaagagcattctacaccagctcacagcctccctcgcagtggcagaggcatcactgcgctttgagcaccgagacttacactgggggaacgtgctcttaaagaaaaccagcctcaaaaaactccactacaccctcaatgggaagagcagcactatccccagctgtgggttgcaagtgagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccatccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcacagtggcgtgcgcctgtagtcccagctactcgggaggctgaggcaggaggatcgcttgagcccaagagttcatatctagcctggtcaacatagcaagacccctgtctctatttttttaaataaataaactacatgtgaaaacaaa

SEQ ID NO: 132 - DNA, 6792 bp, Homo sapiens
ggtggggcatccgggtctcttggtggctgcttctacccccggagctcagctgatcttcccttccagactacgaggtgtgaatttcaaacttccgtaatggagttagcccacagtttattgctaaatgaagaagctttggctcaaatcaccgaagcaaaaagaccagttttcatctttgaatggttgcgatttcttgataaagtcttggttgctgccaacaagaccgatgtaaaggaaaaacagaaaaaacttgttgaacaattaactggattaataagtagttcacctggaccacctacacgaaaattattagctaaaaatctcgcagccctttatagcattggggatacttttacagtttttcagacacttgataaatgcaatgacattatcagaaataaagatgacactgcggcctacttaccaacaaaattggctgcggtggcttgtgtcggagcattttatgaaaaaatggggagaatgttgggcagcgcatttccagaaacggtaaataatctattgaaatctctgaaaagtgcagagtctcaagggcgaagtgaaatcttaatgagtctacagaaagttctaagtggactgggtggtgcagcagcttcctcccatcgtgatatttacaagaatgccaggtctctcttgactgataggtcaatggctgttcgatgtgcagtggccaagtgtctactagaactacagaatgaagctgtatttatgtggactgctgaactagaaaatatagccactctctgctttaaggctttggaaaactcaaattatggggtacgagtggcagtgtctaaacttttaggaacagtcatggccacagcattaatgccaaaacaggcaacagtaatgcgtcagaatgtgaagcgagcaacatttgatgaagtcttagaactcatggccacaggatttctgcgtggagggtcaggtttcttaaagagcggtggagaaatgttaaaagttggagggtccgttaatcgtgaagtgagagttggagttacgcaggcgtatgttgtttttgtgacaacattgggtggtcagtggttggagcgcagctttgccacgttcctgtcccatgtacttgatctggtttcccatcctcgggcaacacaaacacatgtggaggctgtgtactccagacgatgtgtttcctttatcctaagagctactgtgggcagtttgctaggtgaaaaagcccagattgcagctgccaaagaaatctgccaagctattggaaaacaaatgaaagccgtagaagcagtagtgaatgacacaagtggagaaaacaaatctggcgcagcagacattgcagcaagccagcatgtgatggtctgtgccctccaggaactcgggagcctggtgcagagcttgaatgccaccgcatcccctcttattcaagaagcatctatagggcttttggagattgtgacttcagtgctgcttcatccaagcatggctgcccgacttgctgctgcatggtgtttgcgctgtgtggctgtggcattacctttccagctgacaccatttctagacaggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaagc

SEQ ID NO: 133 - DNA, 1157 bp, Homo sapiens
gctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttc

SEQ ID NO: 134 - DNA, 1241 bp, Homo sapiens
tttttattctttctgccaggtacatcagatccatcaggtccgagctgtgttgactaccactgcttttcccttcgtctcagttatgtcttggaagaaggctttgcggatccccggagaccttcgggtagcaactgtcaccttgatgctggcgatgctgagctccctactggctgagggcagagactctcccgaggatttcgtgttccagtttaagggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaagggcttctgcactgactcctgagactattttaactaggattggttatcactcttctgtgatgcctgcttatgcctgcccagaattcccagctgcctgtgtcagcttgtccccctgagatcaaagtcctacagtggctgtcacgcagccaccaggtcatctcctttcatccccaccccaaggcgctggctgtgactctgcttcctgcactgacccagagcctctgcctgtgcatggccagctgcgtctactcaggtcccaaggggtttctgtttctattctttcctcagactgctcaagagaagcacatgaaaaacattacctgactttagagcttttttacataattaaacatgatcctgagttatctgtaaaaaaaaaaaaaaaaaa

SEQ ID NO: 135 - DNA, 1267 bp, Homo sapiens
acattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagtgtggatatgcctcttcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaaaaaaaaaaaaaaaaa

SEQ ID NO: 136 - DNA, 3714 bp, Homo sapiens
ggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccagcctttgatgtctttcaaagcttctgtggtgcgccctggattgagaaccaccacccgaggggtacagcccctctcttccaaccgagaagttcctgtcccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcag

SEQ ID NO: 137 - DNA, 2276 bp, Homo sapiens
ctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccataaaaaaaaaaaaaaaa

SEQ ID NO: 138 - DNA, 1817 bp, Homo sapiens
ctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccataaaaaaaaaaaaaaaa

SEQ ID NO: 139 - DNA, 14294 bp, Homo sapiens
gcgcggagcgagcgagcgagagagcggcgcgggccgggccatggggtggcgggcggcgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagttccgagaggtgtccgaggctgtggtagacacgctggagtcggagtacttgaaaattcccggagaccaggttgtcagtgtggtgttcatcaaggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccacccccatcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcatgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggccagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcaattgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggcggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagcccaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccacctcgtctcccctgccgactcaggcgagtatgtgtgtcgtgcagccagcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcaggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgccaaaaaaa

SEQ ID NO: 140 - DNA, 2984 bp, Homo sapiens
gcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgatttttttttttttttcagagacggggtctcgcaacattgcccagacttcctttgtgttagttaataaagctttctcaactgcc

SEQ ID NO: 141 - DNA, 1741 bp, Homo sapiens
cgtgtttttccagatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgatttttttttttttttcagagacggggtctcgcaacattgcccagacttcctttgtgttagttaataaagctttctcaactgcc

SEQ ID NO: 142 - DNA, 2088 bp, Homo sapiens
ggtccgagttcggaatttcggttcaaggcccagttcctcggattgttcctgcgcaacttcagtttcccttccaggcacgggcaatgagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaaaaaaaaaaaaaaaaaaaaaaaaaaaaaaaaaaaaaaaa

SEQ ID NO: 143 - DNA, 6333 bp, Homo sapiens
gtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgagaaaaaaaaaaaaaagccgaaaaaaaaaaaaaaaacacctgaatgcggaagagctcggctcccgtttagcattttgtacttaaggaaataaaaaaccaacaaaggatctcacattttcttaaaaagtgaagattgctgtatactatttattcaacttataatttatgttactccttgatctttgtcttttgtcatgacaaagcatttatttaataaagttatgcattcagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 144 - DNA, 1376 bp, Homo sapiens
ggcagtgggactgggtttgagctgggcttatcctccaactgtgagggaggctacagcacactccaccccactctcagggctgggaattgttgtggctcagctatttgggggaatctgttttccagtttctcagaaccagcgcaagcacacacatcccaggctcacacccctggtggctggacttgctcccggatagcctcagtcagggagaggcagagctgcctggagcctgctgggctggtggaagccttggtggattctggcaggccaattatagacgaatggcctggggaacccgtgcagcccttggctgagtggttctaagccccagcacgtctgcctctggcttcacccagcctccttttctaactgcccttctctcctccccatcagtgaggaccagacaccactgattgcaggaatgtgttccctccccatggcaagatactacataattaaatatgcagaccagaaggctctatacacaagagatggccagctgctggtgggagatcctgttgcagacaactgctgtgcagagaagatctgcatacttcctaacagaggcttggcccgcaccaaggtccccattttcctggggatccagggagggagccgctgcctggcatgtgtggagacagaagaggggccttccctacagctggaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaacctctaaaaaaaaaaaa

SEQ ID NO: 145 - DNA, 1030 bp, Homo sapiens
agttggagtctccagggatcagggttccaggaactcaggatctgcagtgaggaccagacaccactgattgcaggaatgtgttccctccccatggcaagatactacataattaaatatgcagaccagaaggctctatacacaagagatggccagctgctggtgggagatcctgttgcagacaactgctgtgcagagaagatctgcatacttcctaacagaggcttggcccgcaccaaggtccccattttcctggggatccagggagggagccgctgcctggcatgtgtggagacagaagaggggccttccctacagctggaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaacctctaaaaaaaaaaaa

SEQ ID NO: 146 - DNA, 1802 bp, Homo sapiens
gggcagctccaccctgggagggactgtggcccaggtactgcccgggtgctactttatgggcagcagctcagttgagttagagtctggaagacctcagaagacctcctgtcctatgaggccctccccatggctttagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagcggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaagaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctaaaaaaaaaaaaaaaaaaaaaaaaaaaaaaaaaaaaaaaaaaaaaaaaaaaa

SEQ ID NO: 147 - DNA, 1865 bp, Homo sapiens
gggcagctccaccctgggagggactgtggcccaggtactgcccgggtgctactttatgggcagcagctcagttgagttagagtctggaagacctcagaagacctcctgtcctatgaggccctccccatggctttagctgacttgtatgaagaaggaggtggaggaggaggagaaggtgaagacaatgctgactcaaaggagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagcggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaagaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctaaaaaaaaaaaaaaaaaaaaaaaaaaaaaaaaaaaaaaaaaaaaaaaaaaaa

SEQ ID NO: 148 - DNA, 1760 bp, Homo sapiens
atttctttataaaccacaactctgggcccgcaatggcagtccactgccttgctgcagtcacagaatggaaatctgcagaggcctccgcagtcacctaatcactctcctcctcttcctgttccattcagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagcggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaagaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctaaaaaaaaaaaaaaaaaa

SEQ ID NO: 149 - DNA, 1973 bp, Homo sapiens
gggcagctccaccctgggagggactgtggcccaggtactgcccgggtgctactttatgggcagcagctcagttgagttagagtctggaagacctcagaagacctcctgtcctatgaggccctccccatggctttagggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcacaagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagcggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaagaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctaaaaaaaaaaaaaaaaaaaaaaaaaaaaaaaaaaaaaaaaaaaaaaaaaaaa

SEQ ID NO: 150 - DNA, 591 bp, Homo sapiens
ccgctgtcaagatgcttctggccatggtccttacctctgccctgctcctgtgctccgtggcaggccaggggtgtccaaccttggcggggatcctggacatcaacttcctcatcaacaagatgcaggaagatccagcttccaagtgccactgcagtgctaatgtgaccagttgtctctgtttgggcattccctctgacaactgcaccagaccatgcttcagtgagagactgtctcagatgaccaataccaccatgcaaacaagatacccactgattttcagtcgggtgaaaaaatcagttgaagtactaaagaacaacaagtgtccatatttttcctgtgaacagccatgcaaccaaaccacggcaggcaacgcgctgacatttctgaagagtcttctggaaattttccagaaagaaaagatgagagggatgagaggcaagatatgaagatgaaatattatttatcctatttattaaatttaaaaagctttctctttaagttgctacaatttaaaaatcaagtaagctactctaaatcagtatcagttgtgattatttgtttaacattgtatgtctttattttgaaataaat

SEQ ID NO: 151 - DNA, 7878 bp, Homo sapiens
ttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagaataaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtaagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaaagttgcagaattcatttgatttatgagaaacaaaaattaaattgtagtcaacagttagtagtttttctcatatccaagtataacaaacagaaaagtttcattattgtaacccacttttttcataccacattattgaatattgttacaattgttttgaaaataaagccattttctttgggcttttataagttaaaaaaaaaa

SEQ ID NO: 152 - DNA, 6082 bp, Homo sapiens
ataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaattacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgatacacgctgatttagaaaatacagaaaccatacctcactaataactttaaaatcaaagctgtgcaaagactagggggcctatacttcatatgtattatgtactatgtaaaatattgactatcacacaactatttccttggatgtaattctttgttaccctttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgccttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatctgagcacagtgaaagcagagtactatggttgtccaacacaggcctctcagatacaaggggaacacaattacatattgggctagattttgcccagttcaaaatagtatttgttatcaacttactttgttacttgtatcatgaattttaaaaccctaccactttaagaagacagggatgggttattcttttttggcaggtaggctatataactatgtgattttgaaatttaactgctctggattagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgtaaaaaaaa

SEQ ID NO: 153 - DNA, 3962 bp, Homo sapiens
cgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctgggtccttgtgggcgcaccaaaggcagattccaaatacagcccttcagtgaagtctcctggggctgtgtttaagtgccgtgttcacaccaaccctgaccggagatgcaccgaactggacatggctcgagggaagaatcggggcacgtcctgcggaaagacctgccgggaagaccgcgatgatgagtggatgggggtgagcctggcccgacagcccaaggctgatggccgtgtgttggcctgtgctcatcgctggaagaacatctactatgaagccgaccacatcctaccccatggcttctgctacatcatcccctccaacctccaggccaaaggcaggacgctgatcccttgctatgaagagtataagaagaagtacggagaggaacacggctcctgccaggctgggatagcgggcttcttcaccgaggagctggtggtgatgggtgctccagggtcattttattgggctggaaccatcaaagtgctgaaccttacggacaacacctatttaaaactgaacgacgaagtgatcatgaacaggcggtacacctacctgggctacgcagtgaccgctggccacttctctcacccgtccaccattgatgtggtaggaggtgccccacaggacaaaggcatcggcaaggtttatattttcagagctgaccgaagatcaggcaccttaattaagatctttcaagcatcaggtaaaaagatgggctcttacttcggctcctccttgtgcgcagttgacctgaatggggacggcctctctgacctgctggtgggggcccccatgttttctgagatcagggatgagggacaggtcactgtctacatcaacagaggaaatggagccctcgaggagcagctggctctgactggggatggtgcctacaatgcgcactttggagagagcattgccagcctggacgatctggacaatgatgggttcccagatgtggccattggtgcacccaaggaggatgacttcgcaggggcggtctatatctatcatggtgatgccggtgggatagtccctcagtactcaatgaaactgtctgggcagaagataaatccagtgctccggatgtttggtcagtccatatcgggaggcattgatatggatggaaatggctatcctgatgtcactgttggagccttcatgtccgacagcgtggttcttctcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcagactgtttttgaaaggaattgccgttcagaggactgtgccgcagacctgcagcttcagggtaaactgctgctctccagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggaggagatgggcatctcctgtgagctgctggaatcggacttcctcaaatgcagcgtgggatttcctttcatgaggtcaaagtcaaagtatgaattcagcgtgatctttgatacaagccacctgtctggggaagaggaagttctcagcttcattgttactgctcagagtggcaacacggagcgctctgaatccctgcatgacaacaccctcgtgctgatggtgccactgatgcacgaggtggacacgtccatcaccggaatcatgtctccaacctcctttgtatatggcgagtccgtggacgcagccaacttcattcagctggatgacctggagtgtcactttcagcccatcaatatcacccttcaggtctacaacactggcccaagcacccttccagggtcatctgtcagcatctctttccctaatcgactctcatctggtggtgcagagatgtttcatgtccaggaaatggtggtgggccaagagaagggaaactgctctttccagaaaaacccaactccctgcatcatccctcaagaacaagaaaatatcttccacacaatatttgcttttttcacaaagtctggaagaaaagtcttggactgtgaaaaaccaggaatttcttgcctaacagcacactgtaactttagtgctcttgctaaagaagaaagtcgtactatagacatttacatgctgctgaacacagaaatactgaaaaaggacagttcgtctgtcatccagttcatgtcccgcgccaaggtgaaggtggatcctgccctaagggtggtggaaatagctcatgggaacccagaagaggtgacggtggtcttcgaggccctgcacaatctggagccccgtggctacgtcgtggggtggatcatcgccatcagtttgttggtgggaatcctcatcttcctgctgctggccgtgctgctctggaagatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaagatgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaagcactgatatctggcctaaaatcttggaagtacatgtccatgaatacaaattttaaaggatgaaaatcttaccgtactttggaacttgctgtttaaaaagacagatgaaataagttgaagaaacctcatgtaatgaatccaccaggctggcagtggtgcatataaactgtgggtgtggcaagaccccgaagacatttcacatctttatcgcctcgatcaagtgtggagtcacatgctaatgtgtgctaaagaactgtaagtgttttttcatatgtacttttcattggaagattcccaacaagaatttggatggaaaacctgatccctagcaagaagtctgctctgtatcacctttatatagcagacatgtcaccctgcttctacacagatgatggatgaa

SEQ ID NO: 154 - DNA, 3878 bp, Homo sapiens
ccgcctcctggcctcctggctgaggggaagctgagtgggccacggcccatgtgtcgcactcgcctcggctcccacacagccgcctctgctccagcaaggatgtggctcttccacactctgctctgcatagccagcctggccctgctggccgctttcaatgtggatgtggcccggccctggctcacgcccaagggaggtgcccctttcgtgctcagctcccttctgcaccaagaccccagcaccaaccagacctggctcctggtcaccagccccagaaccaagaggacaccagggcccctccatcgatgttcccttgtccaggatgaaatcctttgccatcctgtagagcatgtccccatccccaaggggaggcaccggggagtgaccgttgtccggagccaccacggtgttttgatatgcattcaagtgctggtccggcggcctcacagcctcagctcagaactcacaggcacctgtagcctcctgggccctgacctccgtccccaggctcaggccaacttcttcgaccttgaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggcaccgagattgccatcatcctggatggctcaggaagcattgatcccccagactttcagagagccaaagacttcatctccaacatgatgaggaacttctatgaaaagtgttttgagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggcacggttggagacgcccttcactaccagctggcacagattggcttcagtgctcagatcctggatgagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggttacgctgtggccgtgctgcacaagacctgcagcctctcctacatcgcgggggctccacggtacaaacatcatggggccgtgtttgagctccagaaggagggcagagaggccagcttcctgccagtgctggagggagagcagatggggtcctattttggctctgagctgtgccctgtggacattgacatggatggaagcacggacttcttgctggtggctgctccattttaccacgttcatggagaagaaggcagagtctacgtgtaccgtctcagcgagcaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaatggacactgggacggcctctccgccagcccctcgcagcggatcagagcctccacggtggccccaggactccagtacttcggcatgtccatggctggtggctttgatattagtggcgacggccttgccgacatcaccgtgggcactctgggccaggcggttgtgttccgctcccggcctgtggttcgcctgaaggtctccatggccttcacccccagcgcactgcccatcggcttcaacggcgtcgtgaatgtccgtttatgttttgaaatcagctctgtaaccacagcctctgagtcaggcctccgcgaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagagctctgtgaggaggactgcttctccaatgccagtgtcaaagtcagctaccagctccagacccctgagggacagacggaccatccccagcccatcctggaccgctacactgagccctttgccatcttccagctgccctatgagaaggcctgcaagaataagctgttttgtgtcgcagaattacagttggccaccaccgtctctcagcaggagttggtggtgggtctcacaaaggagctgaccctgaacattaacctaactaactccggggaagattcctacatgacaagcatggccttgaattaccccagaaacctgcagttgaagaggatgcaaaagcctccctctccaaacattcagtgtgatgaccctcagccggttgcttctgtcctgatcatgaactgcaggattggtcaccccgtcctcaagaggtcatctgctcatgtttcagtcgtttggcagctagaggagaatgcctttccaaacaggacagcagacatcactgtgactgtcaccaattccaatgaaagacggtctttggccaacgagacccacacccttcaattcaggcatggcttcgttgcagttctgtccaaaccatccataatgtacgtgaacacaggccaggggctttctcaccacaaagaattcctcttccatgtacatggggagaacctctttggagcagaataccagttgcaaatttgcgtcccaaccaaattacgaggtctccaggttgtagcagtgaagaagctgacgaggactcaggcctccacggtgtgcacctggagtcaggagcgcgcttgtgcgtacagttcggttcagcatgtggaagaatggcattcagtgagctgtgtcatcgcttcagataaagaaaatgtcaccgtggctgcagagatctcctgggatcactctgaggagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgcagtaaaaaaaaaaaaaaaaaa

SEQ ID NO: 155 - DNA, 4894 bp, Homo sapiens
cgccgcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgtgccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgttttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagccctgtctcacccatggattactccttactgtagggaatggcagtatggtagagggataaatagggggcggggagggatagtcatggatccaagaagtccttagaaatagtggcagggaacaggtgtggaagctcatgcctgtaattataaccttcagctactaagacaggtgtggtggctcacgcctgtgattataatcttcagttactaagacagagtccatgagagtgttaatgggacattttctttagataagatgttttatatgaagaaactgtatcaaagggggaagaaaatgtatttaacaggtgaatcaaatcaggaatcttgtctgagctactggaatgaagttcacaggtcttgaagacca

SEQ ID NO: 156 - DNA, 4025 bp, Homo sapiens
cccggctctgcccgcccttcgaaagtccagggtccctgcccgctaggcaagttgcactcatggcacctccaagtgaagagacgcccctgatccctcagcgttcatgcagcctcttgtccacggaggctggtgccctgcatgtgctgctgcccgctcggggccccgggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgcttttacttccccaattggtttgggctggagaagtgccaccgcttcgggctacgcaaggatttggccagtgctatccttgacctgccagtcctggagcacctctttgcccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtcctccagcccttctgcgactttccagaaatcgtagacattagcatcaagcaggccccgcgcgttggcccggccggagagcaccgcctggtcactgttaccaggacagacaaccagattttagaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcactctggactttgccatcaacaagctcaagactgggggctcacgtcctggctcctatgttctccgccgcagcccccaggactttgacagcttcctcctcactgtctgtgtccagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaagaaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggttcacgagctcatgaagctgtgctgggcccctagcccacaggaccggccatcattcagcgccctgggcccccagctggacatgctgtggagcggaagccgggggtgtgagactcatgccttcactgctcacccagagggcaaacaccactccctgtccttttcatagctcctgcccgcagacctctggattaggtctctgttgactggctgtgtgaccttaggcccggagctgcccctctctgggcctcagaggccttatgagggtcctctacttcaggaacacccccatgacattgcatttgggggggctcccgtggcctgtagaatagcctgtggcctttgcaatttgttaaggttcaagacagatgggcatatgtgtcagtggggctctctgagtcctggcccaaagaagcaaggaaccaaatttaagactctcgcatcttcccaaccccttaagccctggccccctgagtttccttttctgtctctctctttttattttttttatttttatttttatttttgagacagagcctcgctctgttacccagggtggagtgcagtggtgcgatctcggctcagtgcaacctctgcttcccaggttcaagcgattctcctgcctcagcctcccgagtagctgggattacaggtgtgcaccaccacacccggctaattttttttatttttaatagagatgaggtttcaccatgatggccaggctgatctcgaactcctaacctcaagtgatcctcccacc

SEQ ID NO: 157 - DNA, 1518 bp, Homo sapiens
cagagagaagaagaaatatttccaaatataccaggctgatctttcgtagtttctcagtcttgctgtctgttgttgtttgaaatctgtttcccacgagactctgggaagatggaggtgcagggcttgggtaacagctgccttcctcagggctgggtacctgctctccgagtctgtgtctccaggctgtgtgctcagacttgaccatgtttgggcatggaggcttgccccagatggggaccaaaagctgcttccctggagacgggcggggaggccaaacttcctgctgaagctctgtggcctcttttggggtgggggcgggggtccaggcagaaagaaactgtctgctgctcaagacccacaggacgccgggaagactaaatgatcactgcccccagtgaatatggtgaagaagctggtgatggcccagaagcggggagagacacgagccctttgcctgggtgtaaccatggtggtgtgtgccgtcatcacctactacatcctggtcacgactgtgctgcccctctaccagaaaagcgtgtggacccaggaatccaagtgccacctgattgagaccaacatcagggaccaggaggagctgaagggcaagaaggtgccccagtacccatgcctgtgggtcaacgtgtcagctgccggcaggtgggctgtgctgtaccacacggaggacactcgggaccagaaccagcagtgctcctacatcccaggcagcgtggacaattaccagacggcccgggccgacgtggagaaggtcagagccaaattccaagagcagcaggtcttctactgcttctccgcacctcgggggaacgaaaccagcgtcctattccagcgcctctacgggccccaggccctcctcttctccctcttctggcccaccttcctgctgaccggtggcctcctcattatcgccatggtgaagagcaaccagtacctgtccatcctggcggcccagaagtagagccatccatccatgccataccacttgtcagggcacaggggactggctgggcccccagggctgctccccacttgcagcacaatgccttctccacctgccctcccactcttccagtccaatccacgctgtcttctgttgcaggactaacctttgagaaatccttttgtgaagtcattgcctgctcaagaatgtacagtggctccccaatgccttggaggccataaggccagccagttctagctctctattacctgtccccactcaactgactcatacctgtttccggctgcatcactatgtgccccacagagaacgatgatcgtcacctctgtgcctgagttctccctgttgtctcaaagcggtacccatcctcccccagaagctgtccccagcgagcctcccttctttgtttgaattctctaataagagcaacagcagctcccatttctagaacacatttacagtattactattttctaggatataaagtgccatatatatttttaattccaatattaataaatgtatgccaaacaacaata

SEQ ID NO: 158 - DNA, 1688 bp, Homo sapiens
acttccgctggcccaagtgatctgcatgtggcagggctgcgcagtggagcggccagtgggcaggatgacgagccagacccctctgccccagtccccccggcccaggcggccaacgatgtctactgttgtggagctgaacgtcgggggtgagttccacaccaccaccctgggtaccctgaggaagtttccgggctcaaagctggcagagatgttctctagcttagccaaggcctccacggacgcggagggccgcttcttcatcgaccgccccagcacctatttcagacccatcctggactacctgcgcactgggcaagtgcccacacagcacatccctgaagtgtaccgtgaggctcagttctacgaaatcaagcctttggtcaagctgctggaggacatgccacagatctttggtgagcaggtgtctcggaagcagtttttgctgcaagtgccgggctacagcgagaacctggagctcatggtgcgcctggcacgtgcagaagccataacagcacggaagtccagcgtgcttgtgtgcctggtggaaactgaggagcaggatgcatattattcagaggtcctgtgttttctgcaggataagaagatgttcaagtctgttgtcaagtttgggccctggaaggcggtcctagacaacagcgacctcatgcactgcctggagatggacattaaggcccaggggtacaaggtattctccaagttctacctgacgtaccccaccaaaagaaacgaattccattttaacatttattcattcaccttcacctggtggtgatcctcaggagcagagactgttatgaattctggcgtggcttatgaaattaaaagttgccatcaaagccattttcttttaatttcacaaacatcaggcaatttccagggttggtctagagtcttgccactaaatattgatcactcgtttaaggactttccactccattgcaactgatgccactatatttgcctagcaacttgcagctacttccttttcaaagcctcatgtatctcccagacccttctcttgaagtccaataacaagaccaagtaagaatgtttcaacaatgcgttggcaagagatgtgagatgacaacaggaacatacaagatactgtgaatctagatgttctgacctaaagatgtagtctacatagccccagcttggggtccaatccatctgtccctggcatgtgccttcatgtagtaggtgctttcctgatcccctttgcgagatgctgtgggtgctaacacctcagagctgtcctcttctctagagtggaggttttcaaagtgcatcatcagcattacctgtgaacttgctggaaatacaaatcctcaggccccacctcagacctactgaatcagaatctctgggggttggcacagcattctgatttaccaaaccctccaagtgattttgatgtattctaattttgagaccatctctagaaaagaattgctacctcttgtatggaggtacaaaagactgacctcttacatcaaggaacttcctttcccagagctcctcatggaatcaagctgaagtcagtcttcttctgagagcacattcttactcagtttttttcctctgtcctacgctgcttccctcactccccttctcctaagagcactccatcaataaaccacttgcacgagaaaaaaaaaaaaaaaaaa

SEQ ID NO: 159 - DNA, 5832 bp, Homo sapiens
actgagtcccgggaccccgggagagcggtcagtgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaagctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacacccccaactcccggacatcacatgagaggtgctgctcagattttcaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctctttttcattcatttaaaaagcatttatcatgccccctgctgcgggtctcaccatgggtttagaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttga

SEQ ID NO: 160 - DNA, 5200 bp, Homo sapiens
actgagtcccgggaccccgggagagcggtcagtgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaagctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacacccccaactcccggacatcacatgagaggtgctgctcagattttcaagtgttgttctttccaccagcaggaagtagccgcatttgattttcatttcgacaacaaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccc

SEQ ID NO: 161 - DNA, 5050 bp, Homo sapiens
actgagtcccgggaccccgggagagcggtcagtgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaaggtatctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacacccccaactcccggacatcacatgagaggtgctgctcagattttcaagtgttgttctttccaccagcaggaagtagccgcatttgattttcatttcgacaacaaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccc

SEQ ID NO: 162 - DNA, 7567 bp, Homo sapiens
tgctgggtcctgccaccaccatggttccagtggttgagctttgctgaagcccaggcatcatgtacagtgtagaagacctcctgatctctcatggatacaagctgtcaagagaccccccagcatcacgcgaggataaccccaaggggcgccaggcagcgaggactgggacacgagcaggccagggcctgcagaacgggcatgaggatggccctgcggccctcgcacatcgtaagacgtccgcggggaaaggacatgtgagtgactccgaaagccgccgcagcacaccgagaggccacggggagccccagagcacttctgcttccagaacctcggaggcggggttttgtaatcaacccccctcagcatggtcctctcatcccccgactggtaacgaccaagcctaccggagaagaggacggcaagaagccaggagccagaagccgagggagcacgaaaacctggaggccagaggaatggcccaagcccacagcctgcctgtccacgtgagggagggtccatgggaagttggaggaaggtcagagcatgtgatgaagaagccagtttgggaagaagaattgcgaatgtcaggtcctgccaagtggcagaacgtcagcctggaaagctggaaccagccaaggaaattagggaggcagatgtctgatggagatggggagagactgtttcaagacctgtacccattcattcaaggagaacatgtgttgaattctcaaaacaaagggaagtctcgctcactgcctagagttctttcccccgagagcctgagttgcacggaaattcccattccattaaatgaaagacattcacctaaaatgccaccgtatcctcccacttgcgcaccaaatttggactccacgaggaattctgagaagagtggctgctcagccccatttccccggcctaagtttgggaggcccctcaagcccccatcttacagctcgcaccagcagtctaggggaggagcggacagcagtgactctcaggacagccagcagatggacgcctatgtccccaggcatgagctctgcctgtcagaccctggattggaacctccagtgtacgtgcctccgccctcatacagatcgcccccgcagaacatcccaaacccctacttggaagacacggtgcccataaatgtgtgtggcggtcacagtcaacagcagtctccgaccgagaaggctggggccagcggtcagcctccttcaggcccccctggaactgggaatgagtatggtgtgagcccccgcttgcctcaggggctccccgcacatccccgacctgtcactgcctatgacggcttcgttcagtacattccctttgatgatccacggttacgacattttaaactagctcagccccagggtttctgtgaagacataaagcttgacgataaatcatataactccagtcctgtcactgctcaagagccggctcatggaggaatgcagcctgatggtgccatttggaatccacagagcttaatacccccgtcgggggatgagagaggcctggtcttggccgattccagcccccggtggctgtggggccagccccccggggatggggaaaacagtggcctccccaaccagagagaccgctgtgtggcaaggggacagtggcctgatgtgagaggcagccagcacgggcacactggaagacaagtttcctccccttactcacagggcgagagcacctgcgaaactcaaaccaagctcaaaaagttccaaactgggactcggaccaagaaaagttcaaagaaaaaaatgaacgagactatattttgcttggtttctatcccagtgaaatcagaatcacatctgccagatagagatatggacaacaatgacttaaagcccagtgctgatcaaaagaatgggtctgataagagcccggctctgcaagaacagagtctgctgagcatgtcttccaccgacctggagctgcaggccctcacaggaagcatgggtgggagaacggagttccaaaaacaagatctaggggaaccagaagaagacagacaaacaaatgacctcagtttcatccaccttacaaagcacagagaactcaagcattctggctcttggccagggcaccggtacagagatcagcaaacacaaaccagtttctccgaggagccccaaagttcgcagctgctccctggtgcaaagctgggagggccgagtcgtgcagcattgagtccaaaatgttcagaccctgctgcctccgaagctcagacgcacacagcattccctaccggtgatcacaaacagaggccaagtgcccgtaacctgaaaggtcacaggtccctcagcccatccagcaacagtgcgttctcaaggacttccttgtccgtggaccaggcaccgacgccaaaagcaggccgaagtcagccctgcgtggatgtccacgggcttggagcccaccctgggcctaagcgggaggtggtgaagggggagcccacgggcccttgcaacagtaaacaactctttgggcagtttctcctgaaaccggtcagccgtcgtccctgggatttgatcagtcagttagaaagttttaacaaggagctccaggaagaggaagaaagcagcagtagcagcagcagcagcagcagcagcagtgaggagagtgaggcggagccgcagcaggagaaccgtgctcactgcagacaggaggatgtgggcttccgcggaaacagcccggaaatgagggttgagccacagccgaggatgtgggtgccggagagccctgtgtgtaggtcgggaagaggtgagagtaagtctgagagctggagtgaggagctgcagcctggccacccacgtgcctggcctccatccccgggccgctttcgcgtggaagaaggtggcggtgcacctttctgctcagcagatggaagcacgagtgcagagaagagacacctggaggttagcaacggaatggacgagctggcaggtagcccatttcctgtgacgagaatgtcttcaagatcaagtgacgcaaaaccactgcccgcgtcctatccagctgaacctagggagccccaggaaagtccgaaaatcaccagtgctttcagctctgtgaaaccaagtgaagcggtccctcggaagtttgacagtggtggagagaggggggcagggctcccactgtccctgtctaacaagaaccgagggctctcagctccagacttacggtctgtggggctcacccctgggcaagaacagggtgccagtgagctagaggggtctttgggtgaagcaagcacaatagaaatccccccaggtgagtccttgcaagccagggctgcaaggatcctgggcattgaggtggcggtggagtccctcctgccgggcatccggagagcgggacagaaccagcctgctgagcccgatgcaagtgcctgcaccccagagtccccccaggaagagttgctatctcgcccagcaccggcagatgtccccagggtgtccactgatgccttttatggcaggaggaagtgcggctggaccaagagccctctctttgtaggggacagggacagtgccaggcgggctcctcaggcttttgagcactcagatgtggacggggttgtcaccagcacagaccctgtccctgagcctgagcccagccccttggagtccaagttcttcgaacaaaaggatgtggaaacaaaaccacccttcaggtccactttattccattttgtagaaagaaccccaagtgtggcaggctctgaaaagagacttagaagcccttccaaagtgattgaaagtttacaagagaaactggcctccccgcctaggagagcagaccctgaccgcctgatgagaatgaaagaggtgagctcagtgtcacggatgagagtcctgagcttcaggaatgccgactcccaggaggacgccgaggaattgaaggccaccacaaggggccaggccgggctcccgggaggccttgtgtctcctggcagtggggaccgtgcccagagattgggccactcactctctgtgtccaaggacagcatctccagggaagagaaggagcatccggcagcacaaaaggagaagagcatggatcaagacttctggtgcccagattcctatgaccctagcagagtggagagggtgtgatgaaatgccggtggagcttgcattccgttgcgaattgagtattctcaagtagctggtagatttagtctatcagccccacttccccatgtagaagctggaagctgctgagtttttagcatcctgataacattctttaccactgccactaggaaacttgccatcctctcagaattgctttgtggcgataaagcaatcgtccgttgaaaccatctgtttttatagcatgaagatttaatgcctataattaggaaggagttttcacagaaaccctccctcatgacagatttgactaagctggtaaatagtttggtgttgctctcattctgggtgaagatttcaatgtggaagatctagcaaatgctttggaaaggcctgtgaatggtgtgctcccctctgtgtctccatggcctgcagtccatgctcttgtgaaggagtttgggacactggctgttgcccggtgtttcagcactttcagtttaggggaaatgtgaatcaataggtatgatccatttctaatcaatttggccttctgctgctggaagtaactttacttataagtaacttgccatcagagaataaaagcaatatcttttaagttcctgaaaaattaaaacttgtactgtaatatactaagagtattatttatctggcagtgaaatattttgatcatttgcaaacacgccattgtctgctttgcactcagtattatctatttttattttctgtatgggtatttagaaattctttatatgaaaaataattgctggtttaaaatagaccattttaacaaagtgactatatttctttttacgaaaatgctatttttctatgatgtaaacaattgttaggcggcagatttttaaggaagtattattttatttaagagtctgtatccctttgtgtgagaggaacccaaagagggttcacttttgctttaaagctctgtcccttacccactgacaactctgctacttttattttatcttagaaaatgtcaatatagacatatcacagggttaataaaagaaacttttcacaaagatttttgtacaagtgtagctatcaggttatatttgaaaataaccctctgaaaaccagccaacattgtcatgacaatttttgctgccgtatcaactagaattaccaaaaaacatagttttatctttgtatgtgtgtggggatctaccctgagaccatgcttttcttcccaccctgccaccccacccctttaaagaaatacgtatttttatctagaatgatcttgaattagtctctgcatatttttagaaagtgcttggggacattatatatatgccattacaaaagcattatgaggcctatgtattctactgtgtttaatactgcattaacctgcacaaagtttatgcattttttcatgcatttttttccttctttctaagtaaggtattcctgacaactaacattccctaaatcatttcccctccctccctccctccctcccttcctttcttccttccttctgtcctccctcccttgctacctcttgccctccttccttcaccctgtcctccttttcccttttattttttccccttctctttcattttattttcttttagagaaaccaccttatctatttttagacatttcgaattcctaaaatgtgaaccgttgggtgatctgtcctttggccctaaaacggctggccgggctgtcccggcctgttctcatctgtaccgtatgattttatttcataataactttatgtatttggactgtaacaaacaaaacagaacctaagtcgccccgaaaaatctttccaagccttttcaaaacacttatctgcagtccagaattcagctcttatgaaaagtgagagtgcactccagttttcacagcagcaataagtgcgggaaacaaaaagatcctcttcccaggaaaagttgagtggggaagagttcagacactgttgtagctggtgaatcattgaagtcacctggtagtaccaaataagggctgaggcgcctggaggtctttgtggggtcttccctctttaaatgcaaacgtaagaaggtatatgtgtatatacatttatatacgtgcacatgtatactcgtacatgtatgcacacatacccatacatgtatatgaactccgttctgatttcctctgaaattttgttgataccatctaaatacctctttgaatcaaaataacttaattttagctcattcctcaagagaaagagaaggatccccaaggaagaaaaactgttgtaccttctgtgattctcaaaccaaaatgtgatgcgcttctgttttgttatcttaaattgttgtatcatatctttctgaaaccattctgaattaagttgaaattttcaacatttatactttaactgttctaaatttaagcctacatgtaaatcttttttggggggaaggtaacttgaaaagtttaacttgaaaatttgacctttaaactttcatattctaaggtaaataatagcctataaccaacaacagctttcccagaggtcttgaatttaacactaattgtttagttattgtttctatttctcatacatacataacttcgttttttgtggctggaagaaaaagtttctatattttgtatttgtctttgttcttctcatgcacacaatttactgttggtgtttaataatttggagctcataaaattaaaagttgtaattttgaccatttgggctaaaaattatatgagggattacatatgcaatggattagtatttcttgatttgcaaaagaagggaaaatgatggtaatttagctcaaattgcctttctttgaagaaaatttctgaatgactgaaaaccaaatatctatattatcactttcaacctcatgtttctgcaaagtacagaaaaactcctcactgacagtgcacccagcccctgactgggttttcaggattatgtccatgtgcataactgcttggatttcttcttttaaagtccctaaaacatgaatctgttctttgagatcctggtttccttagcagagttgtaggttgcgggtttcattcacgtggaaattctaagtagaacttttgctgccccattttactgttggtgaagggccgttgttaatggaagtttacgttttaaaactcagatgactcagaaaccagactgtgatcattttttgcagcagcaaaatgacttattctgacagcatctcggtttggggcttctgaagaaaaaggatgaagctgatctgttgaaacaactactttcccaactcggaggcaaaaggggctgatagaagataacattcacctaccatttcatcttgtgacccccagagatcacgtttgcgtgttctggctgagttttttattattgtttgttttaaatgattaaataatacacaattaaatgtcaggatagcatctcttgcaaagtg

SEQ ID NO: 163 - DNA, 5003 bp, Homo sapiens
cgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggatacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggccgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaacggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactactcgaagaaaggcagaagaagttacaaatagttctgaacatttttctattcattcattttgaaataattatgcagacacatcagctgttaaccatttgcacctctaagtgttgtgaaactgtaaatttcatacatttgacttctagaaaacatttttgtggcttatgacagaggttttgaaatgggcataggtgatcgtaaaatattgaataatgcgaatagtgcctgaatttgttctctttttgggtgattaaaaaactgacaggcactataatttctgtaacacactaacaaaagcatgaaaaataggaaccacaccaatgcaacatttgtgcagaaatttgaatgacaagattaggaatattttcttctgcacccacttctaaatttaatgtttttctggaagtagtaattgcaagagttcgaatagaaagttatgtaccaagtaaccatttctcagctgccataataatgcctagtggcttcccctctgtcaaatctagtttcctatggaaaagaagatggcagatacaggagagacgacagagggtcctaggctggaatgttcctttcgaaagcaatgcttctatcaaatactagtattaatttatgtatctggttaatgacatacttggagagcaaattatggaaatgtgtattttatatgatttttgaggtcctgtctaaaccctgtgtccctgagggatctgtctcactggcatcttgttgagggccttgcacataggaaacttttgataagtatctgcggaaaaacaaacatgaatcctgtgatattgggctcttcaggaagcataaagcaattgtgaaatacagtataccgcagtggctctaggtggaggaaaggaggaaaaagtgcttattatgtgcaacattatgattaatctgattatacaccatttttgagcagatcttggaatgaatgacatgacctttccctagagaataaggatgaaataatcactcattctatgaacagtgacactactttctattctttagctgtactgtaatttctttgagttgatagttttacaaattcttaataggttcaaaagcaatctggtctgaataacactggatttgtttctgtgatctctgaggtctattttatgtttttgctgctacttctgtggaagtagctttgaactagttttactttgaactttcacgctgaaacatgctagtgatatctagaaagggctaattaggtctcatcctttaatgccccttaaataagtcttgctgattttcagacagggaagtctctctattacactggagctgttttatagataagtcaatattgtatcaggcaagataaaccaatgtcataacaggcattgccaacctcactgacacagggtcatagtgtataataatatactgtactatataatatatcatctttagaggtatgattttttcatgaaagataagcttttggtaatattcattttaaagtggacttattaaaattggatgctagagaatcaagtttattttatgtatatatttttctgattataagagtaatatatgttcattgtaaaaatttttaaaacacagaaactatatgcaaagaaaaaataaaaattatctataatctcagaacccagaaatagccactattaacatttcctacgtattttattttacatagatcatattgtatatagttagtatctttattaatttttattatgaaactttcctttgtcattattagtcttcaaaagcatgatttttaatagttgttgagtattccaccacaggaatgtatcacaacttaaccgttcccgtttgttagactagtttcttattaatgttgatgaatgttgtttaaaaataattttgttgctacatttactttaatttccttgactgtaaagagaagtaattttgctccttgataaagtattatattaataataaatctgcctgcaactttttgccttctttcataatc

SEQ ID NO: 164 - DNA, 2399 bp, Homo sapiens
ggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggggcgtctctggccgagcctctttttgtggaaaacgacagcagcagcagtggcctggaagacgccaccgctaactgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttatgctttaaaaaaaaaaaaaaaaaa

SEQ ID NO: 165 - DNA, 874 bp, Homo sapiens
agttcctccacctgctggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagatgctgtgaaggtcgtggagttgcccaccgaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatcc

SEQ ID NO: 166 - DNA, 3024 bp, Homo sapiens
acaatctcccttttcaagccagcctctgtccctcctactcaacctgctttatctctaggccttcctccttcctcttccacagtctggcttctcacattgtcactctagcagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctccgagctaggctggccctgagtcattagcaccttctctgccttcatgaggccactgaactcaagggacctcaccttgcttctatcccagcctctaagaccagagggccgagggggtagtgaagattgggaaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagtctggccaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttttaatagcacctattatacctgaaattaaaaaaaaaaaaaaaaaa

SEQ ID NO: 167 - DNA, 3123 bp, Homo sapiens
catcctgccacccctagccttgctggggacgtgaaccctctccccgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacgcagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctccgagctaggctggccctgagtcattagcaccttctctgccttcatgaggccactgaactcaagggacctcaccttgcttctatcccagcctctaagaccagagggccgagggggtagtgaagattgggaaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagtctggccaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttttaatagcacctattatacctgaaattaaaaaaaaaaaaaaaaaa

SEQ ID NO: 168 - DNA, 2985 bp, Homo sapiens
accagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctccgagctaggctggccctgagtcattagcaccttctctgccttcatgaggccactgaactcaagggacctcaccttgcttctatcccagcctctaagaccagagggccgagggggtagtgaagattgggaaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagtctggccaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttttaatagcacctattatacctgaaattaaaaaaaaaaaaaaaaaa

SEQ ID NO: 169 - DNA, 1133 bp, Homo sapiens
gcacctagcagatcccaagctggggaatgccagttctggcaccaaccttcctgctccctgctggggcctctgctcccccatctctcaggagtcgaaagtgagaaagcaagacatcaaggagggacctgtgccctgctccacatcctcccacctgccgcccgcagagcctgcaggccccgcccccctcgtctctggtccctacctctctgctgtgtcttcatgtccctgagggtcttgggctctgggacctggccctcagcccctaaaatgttcctcctgctgacagcacttcaagtcctggctatagccatgacacagagccaagaggatgagaacaagataattggtggccatacgtgcacccggagctcccagccgtggcaggcggccctgctggcgggtcccaggcgccgcttcctctgcggaggcgccctgctttcaggccagtgggtcatcactgctgctcactgcggccgcccgatccttcaggttgccctgggcaagcacaacctgaggaggtgggaggccacccagcaggtgctgcgcgtggttcgtcaggtgacgcaccccaactacaactcccggacccacgacaacgacctcatgctgctgcagctacagcagcccgcacggatcgggagggcagtcaggcccattgaggtcacccaggcctgtgccagccccgggacctcctgccgagtgtcaggctggggaactatatccagccccatcgccaggtaccccgcctctctgcaatgcgtgaacatcaacatctccccggatgaggtgtgccagaaggcctatcctagaaccatcacgcctggcatggtctgtgcaggagttccccagggcgggaaggactcttgtcagggtgactctgggggacccctggtgtgcagaggacagctccagggcctcgtgtcttggggaatggagcgctgcgccctgcctggctaccccggtgtctacaccaacctgtgcaagtacagaagctggattgaggaaacgatgcgggacaaatgatggtcttcacggtgggatggacctcgtcagctgcccaggccctcctctctctactcaggacccaggagtccaggccccagcccctcctccctcagacccaggagtccagg

SEQ ID NO: 170 - DNA, 1309 bp, Homo sapiens
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 171 - DNA, 1172 bp, Homo sapiens
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 172 - DNA, 1054 bp, Homo sapiens
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 173 - DNA, 11426 bp, Homo sapiens
agacccgccgggctcccgccgcgcgcgctgtccctggagctcggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccaccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgaacaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccaagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagacgcgcaacactgtgtcccgcgaggagctcatgatggtgctggccagcctggagcagctgcagatccgtgccctcttctcacagatctcctcggctgtcttcctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcgtgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcgatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgacggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaa

SEQ ID NO: 174 - DNA, 1823 bp, Homo sapiens
gggacagtcctggcccactgcactgggaatctaggatgggggccttggccagagccctgccgtccatactgctggcattgctgcttacgtccaccccagaggctctgggtgccaaccccggcttggtcgccaggatcaccgacaagggactgcagtatgcggcccaggaggggctattggctctgcagagtgagctgctcaggatcacgctgcctgacttcaccggggacttgaggatcccccacgtcggccgtgggcgctatgagttccacagcctgaacatccacagctgtgagctgcttcactctgcgctgaggcctgtccctggccagggcctgagtctcagcatctccgactcctccatccgggtccagggcaggtggaaggtgcgcaagtcattcttcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtggctgttgaacctcttccacaaccagattgagtccaagttccagaaagtactggagagcaggatttgcgaaatgatccagaaatcggtgtcctccgatctacagccttatctccaaactctgccagttacaacagagattgacagtttcgccgacattgattatagcttagtggaagcccctcgggcaacagcccagatgctggaggtgatgtttaagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatgataccgcctgactctaatatccgactgaccaccaagtccttccgacccttcgtcccacggttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggccactaatgtgtccgccaccttgaccttcaataccagcaagatcactgggttcctgaagccaggaaaggtaaaagtggaactgaaagaatccaaagttggactattcaatgcagagctgttggaagcgctcctcaactattacatccttaacaccttctaccccaagttcaatgataagttggccgaaggcttcccccttcctctgctgaagcgtgttcagctctacgaccttgggctgcagatccataaggacttcctgttcttgggtgccaatgtccaatacatgagagtttgaggacaagaaagatgaagcttggaggtcacagctggatctgcttgttgcatttccagctgtgcagcacgtctcagagattcttgaagaatgaagacatttctgctctcagctccgggggtgaggtgtgcctggcctctgcctccaccctcctcctcttcaccaggtgcatgcatgccctctctgagtctggactttgcttcccctccaggagggaccaccctccctgactggcctgggatatctttacaagcaggcactgtatttttttattcgccatctgatccccatgcctagcagagtgctggcacttagtaggtcctcaataaatatttattaaatgat

SEQ ID NO: 175 - DNA, 4012 bp, Homo sapiens
ctgaaccaaatgaagaggatctggaaggcaaagcactaagatcatagtgaagacctgcctcccccttctccttgtgtcccaccagcctccctgctggcctgaccaggccccatactccagtctccccagagaccccaagctgaagattctgtgggtctgccccattgctgggcacagcagagcctggatggaggcttgttgtcttctgcagttgccccaaaggttgctcttgctgggggcagccgccctgactgcaactgctttggagacagccgacctggcggaactgtgcgggcagacgtggcagggggacgggctgctgctgcgctcgcacgccgcatcgcgcaggttctacttcgtggctccggacaccgactgcgggctctgggtgcaggcggcagcccccggcgaccggatccgcttccagttccgcttcttcctggtctacagcctgacccccgcgcccccggcgctcaacacctcctccccggccccggccgacccgtgcgcccccggctcctacctgcggttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcacctctttccgtctgggaccttgtggtgcctacttccgctgccagaatggcaggtgcatcccctcaagcctcgtgtgtgacccctggggcatggacaactgtggcgatggcagtgaccagggctcctggtcaccagctgactgcagaggtccctctccggtgcccagccagacaggaagtacagatgcccatacctccagatccctgactccctccccagctctcgggtctgcaggatccctctggattgcagctgagaggagttccccagcaggcagggaccccacgagacaagacgcagctttggaaggctccactgagtgaagccctcatcaaagactcaggaggcccctggcggggatagcaccgtttattaagaaaaatcaagacaaagaccacaggagggtcccttctaggacacagaggccaggcgtcccaaccccacagtctgggggccactggcaggatggcacttgagctggatcttcaggctcctgcagatggggcagggtggtcatatccccctcctctctctctcagtcgtgagtcctgccttcccccacctaaggcactagctcttcctgagcaccagcggcatccgtccgtccgttgtctgttggaggagtccctgggccttcacttccagatgggtggggatgtggcctggggtgggcggggcccggtgggcggggccctatcagtgctgggctctgcctgtagcagctcctggtaagagttggggtgggccttcccttacagcccctgagggagggaccccaggctgtgtgctggcaggagggggtgggaatgcaggccaggaggacgtggtaggagggggagtctgccagaggaggtgccaggggctgggtggaggtgggtgggggtgctgaaaaacgagctggtggggatggggaccgcctgcccaggggtgagctgccttttgctccacagccggcactaaagacaattcccaatcctgagtgggtggcagagactcctgcgatgcccgtctcaggtagctgtggggcaccagcccacaagccgaggttggctctcctaggagtgagaactgcccaagggctgcagaaacaggccacccagctctatctgggggctccatcggtgggtagggggacagtgggggcagttctgggcccacccagccactgttcctgaccccaagtcctggtgactttctgaggtgcccactcccatccaacctgccttgctggccagccttgtggctttgcccagctgtgtgtgtgagggtggcatgcccacctccagtccagcccagggcggtagcagcaaagcgtggcatcgcctcggtttcttacaaaaattcataataatattaataataatatactcgacattgtcgggctggggcgtggcccgggagtccgtgtggggcaggcaggtgcctacgaggggcaggggcgtgtgttggccccggcctgggcgcggtgctgcaggtccaggggctgtgggggcggggcgccgggtcgggccgagtgcagcaccaggttcttgacacagcctgtgatgcccgaggagaatctgcccccggtcagcgtggccacgtcaggggctccgcctgccgggaggtgagaggacagggcctgtgggctccagcagcccaggaggcgaggaaggctgggcgagctctagccctaagggagtgccgttcctgcccctgccctgagaaggagccccagacttaccgatgtagacgctgcccttggcgttgactgccacgttgggacctggggaccggccgctgaccagctcctcaccgtcgacttggatggaacctctgcggccctccctgcagtggaactgggtcaggcccctttccacaaacttcctggtcctccccggccccacgacagagtcccctccctctgatatcgagactccagactcagaagtctgtccctgtttcccaagctctttctttcccccgctgaacgagagatcgggccccacaaacacagcttcctcatttctgcacccaggtttcctcccactcctggggcactcgcctgcccccagcggagttcagtccgagatggaagcccgagccctggctggtgggttctcccctcccctggcttcaagttctgtctccacagagctcaatacctgcctctctgcccatggtagggggcgtcctgccccactccagaacgctgggccccatcccgagtgcccggcagggtcccttaccgcagtgctgtcacccggtgccactcgccgtcattgatggggtcctcagagaccaggcgggcctccccactacccagctggtacctgcagtcatccaggcccaagaagtatgagctggggcaggaccggggggtggggtgctgggaccagggaagggagaggaagggccaggtgccaggacctacctgaagacaaggtgcccgtcttgaagcccgaggctgatgaagtccttgccttggccggcctctcccacctcctgccagggaagcacagggtctctggggtccccagcctggagagcagaggctgccgaggccagggggctctgctttcccctccccccaccactccggccaccaggaagccagcttcctgccccaggagccccaagagcccagccggatacccacactcaccacaccctgccagagcaggaggccactggctgtgctggtccgaacctccggctcgatggtctcgggcacctcgggcaggctgcggaggaagagcgggtgaggggacagaagtcccagattcccatcctccccattaggcccatgggcccttccaatgccagtctcaccccctggagaagacatggccagggaaggcgaggaagccatcatcgtggaaataggctccgtactgcccaggggcatctgtgggagagaggagggtggtgccatacctgctgcatcaggcatcaaaatcccccgtcagttcccctgacccccacctccacgccaacatgcaggactagggggctccgagtctgcagtccctggggacccacgggggctgccaacagaattcagggagcctatgaccttggatgggaaagcattacacctcaatttcactcacttctcactgaaattgagcagttctttcaatgagatgtaggcaagaaaccaaagtagcagtggtaggacctgcaactttgttactagtatttgcttatcacatgacagtagctgcaaatatttcaaaatatcatttacacatattgctgctttgaaattgtggtagctactgagatcaccagatcttgttatttgatgtgttaataaagaagcacatatatagcaagtcaggaaactt

SEQ ID NO: 176 - DNA, 10099 bp, Homo sapiens
ctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagtgttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatgtgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcaagccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagctgtccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctgaatccatgggcatacctgtgttgcaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttgtttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggttctctgtgtatgaatcctgattttaactgctaggattcagctaaatttctgagctttatgatctgtggaaatttggaatgaaatgcaattcattttgtacatacatagtatattaaaactatataatagttcatagaaatgttcagtaatgaaaaatatatccaatcagagccatccctaaagagtgttctcttgtcttcctttgtatcctctttggctccttcccttagcttccaccccagacatcagacctggggctgccttctctccctgccaaagcttgctgttagcattgtctgcttgccctcaactcctgccttgttccctgttgaaatgtatcaatcccgtactttatctctccaggacaaggataagtgtggctacagtaaaagtttattgctctaaacggcgctaacctgagataatgagaaaaggccagaagagattgtttgatctctgtctgtcaatatatatgcatttcaactgtgaccatctggatccagggccctttctaacctatataacgactcatttgtttggttaatgatgaatatcactggggctcttaagtcctttcgttctatccaagacttcattgtttttttctgtatgaaaaaagtgcagaatatcactcacctttcccctacttttggatcccctacacgaggatcactagcttaatgagaagcagagtaacgctattaagtctgggcaagctccttataagttgctgtgtgcttaaaagaatgtgatttatgtctggggccaaagcagttttccttcttttccctcattgaattcaagacagctagacccttgtgtagatcccaggatattacctctactccccccaacctgtgtgtgtagggagagtaacaacacgggaagaggggagggaagttggaaggagattggtcacatgttcagttgtctgagatactggtaaatgtgcgctgtttgtcaatgaaggttgcatgcctgcatttacaaggtggtctcatactgattgtgctctgtccagttagattcgtggcttctcccttggaagctacaattaaggactagttagaagcagaggctagatgtgttctctccagcccttactaactgggaaaataattgagaaatccctcttttcctcagtgaaagcccagtcattggttagaaaaatctaattgtcaaactagcattatgttccatcatatctgtgggatagtaattcatgtaagacacatttttacctctcttacaagtcaattcacttacaagccagtttcaaatcaagcttcccttgcgaggaatggagatcattatggggcttattatgactacatttcttttatgagtgaccattttaaataattaatattttatttaatattaaattattaaagacttagctagacttttaacattagatgaaccttgtgaatcatatattgcatagattagcacatgtatgcaatctaggtcatcaatttgttgaatttatacagccctagatttgagattgtggccctgagtatctggatagttgagttgtgtgtttatgtgcttatatgatagaggtgctttgttcctgcagcttagaaacagaagcagccattcactgagaagcttaagagaggaagtatcaacctcattttccaaaccagcattactttcaccgctcgtggatctgaaagattacatttagaacatttagtactattacactctcagaaactgtggtaaaaagtcacattttcaaaacttcatgcatattgtattcttgttggaaataagtcctatagtttcttaattgtcttcatgccgtccatatttaacaaacattgcaagtcctttttatatttgggtaattatttgtaatttagtgaaggagactaggggatgttttcttccaaagggaatttaaaatcaattttatggtattttgaaagtaaaatactccttaacgtgtcaatatttttaaaatgttatctcgaagttttctattgctcaggtatataatctaataaaattttttgtttgctctaaggttatttttgctattctctattttgaattatgttaaaatttgtgtgcattttatgaaatgccttttttcttattttgaaagtgtaaaattgggcatctcagagtaaaatgtgggattattagctacaaagactaggcacatcgtgaaagctcagtaactaattttcttgactgagtcctatcccagagtgtcacagattcaacagaattttcctgaagggtgatacacaccaaaatctagcttgtgtggatctgagactattgactcaaagattcaaatctacttcggaagtgactccacggtttgagtgaaaactgaggaaggactcatgcctgtatatcactagatatcttatttctccataattttaagtgttcataatttcttcttctttgatgggtgtgcaactggggcatgtttgtaccagccagcatgtgttctgcccaacagtgtgtccgtgtgtgaggttaactgattcagaactcattctcttgataaactatttcttgaaagcatttattttaagtctttatttcctgctgaaatgaagtttcatgctgtcatgcccatcttatttattctagaagaaaattttcatagaagaaaatgatttatggccaaagttacagaacattcatcttttagacttagccttagaatatcattggaaattacttggcttgaatttggttcgtttttatctttatggattatgtaccagggctattaataatacttaaaccccttattttgctatggtggttagatttttttattccttttcaattagtgctattaattattacatggtcgtattcatgcttattacagatgaactatttttagtgccagtgtaaaggattaagaataacattcaattagttggctatttcaggctttattgtacatggtaatgtttcagggagtgtgatttggtctagaatatatccagatccttgtaattatgatattgggttatgacaggattctattatttttagctatgaatggtgcttatttttccctatattaggaatgttaatatttggattatcagagtccatgttataaacagaatttacctatgcaagacaaattctaactgtgcaacattttcatgagaattaaaagttgtgtgttaaggggaaaaccctctgaatgtttttatgtgtaagtgcctaaagaaccgtagaaacagtacatcaaaagctcttataaaagaaaaactgattgaacattagccagaaacaaaatatgatttacatttttttttttggttgctgggactgaataccctaaaaactaagagatgtgagtggggaaaatgtctaattgataagaaagttgatttatattatatttacatgcatcttctaagattgcctttacagtagccaatcagaactttaaaaaaaaaaaagctaacaacatagatcctatgtgttgcccttaagactaaaatactttgcacacgtgattgaatggctcacttaagttgttgaatttccttatacatttaaagtgtacttccgttaagaattattccattttaaatgggtaactttcagcttccgaactattttcctaaacattccagttgtgtattataaaagatcaaaatatctctaggtggtagtacaattttcatttataacgtggaaaagttaactgttaggtttaacattagtattagtgtttttgcaattgctcatagaaaagaacactgaataatggttttcatacaatttttgtaaaacattcttctcccagtttgattccaaatgcttttccccaaattgtctaatatatcataagctagtgtttccttgtatttaatttttccttccaacacaatatttaggaaaaatatgaataacattgtgagtagcgggagacaacacgaaaaagaaacctttcattgttgtggaggggtaggtgttatgtgattgatgcccttcctggcgtttgttttatcctgttattttctcaaaaaagagcacggctttttcttaaatacatttaaattcagaattgcttgcaaaagattggcctggatagatagacatcctagatttaagatagtaccatcttaaaagtatgttgaaaggtaaaataaatcatttcaaaatacttaactttcctaataaggatgttaggttttcttctctttcattagctggccataagtcaaggtccttataacactaggaaattacctttttttactttcaaaattgcattatagtgaattactgtttacaaaatacacatactgtgaacagatataagtttctgtcttttataaggtttgtagaatgaatgtttttttaaagtgagtattatatgttaaatattttaagttttttataaatactagtaactgtttactaatttttgtttggtcaaatgcttgtaaatgtagctgaaagaagatagggagaaactgcggatcccaaactgttccctttttcatttcttgaaatgttaccactacagacatttttttaaggtgaataaacagttgtgatgtgctgtacctaaaatcatgtttaatcgtataaggaaacatttcaatacacttatacaggaagaaaactatagatgaagtacatgtgtgtgattcagtctgattcacagaattctgagagtaatatggaataaaacaactccacttagatgataactgaagcatttcctgccttgtgaaaatttggattttaaattgctgttagaatgggaaatttggacactttatatcattgtataatttcagaatttagtttctgtatcttttggaaaacatgattatagcaaaaacatagaaaataatctattactaaaacaccataaatgtaaaactagtatgcttggctgttaactctaaagatgttacttatgtctgtttttaaaacatgcatgtatttaacaattttatcatagtattgtcatggaaaaaataaatatattttcttacatcttaaaaaaaaaaaaaaaaaaaaa

SEQ ID NO: 177 - DNA, 1235 bp, Homo sapiens
agcgcgtcaatcccggcgggaaccccggctgcggaaggcggctgcggccggcgggagccgaggggaagaatggagcgctgaggaagcgaggcgccagccccagccgcttcgctgccgcggagcctgcacgaccgagaggtcgcggagagaagccagagacaggccagcgacctggcgagagagaagatctagctatgttacccaggctggatttgacctcctgggctcaagggatcctcctacctcagccccccacacagcagggactacagctgcacaccactacccagctcccttcttcatgtcttacctgtccttattatcacagtgaataatgcctaatctattagtgaataatgcctaatctattaagagctatgtgaaaaacctaaactctttccatttgcaacccttttggtatggtcaagtcagtggatctggctatcatacaaactcaaatcaactactacaaattcagattggctaagcagattccagccattttaaaagcttgtctctgctctatcctgtatctttctgcatttacatgtaacttcactgtgggtgtccttacagtatatatttttatgagacatcaaacttactaagagtactttatagcatagtatttaggaacttaggggtcagaattaagacattgttactatgtcaccttgagtattttgtttaacttcacaacacttcagtttcctgatcagttaaataattatgataatacaagacatagtagcatcacaggattattatggggcctaaatagataatgtatataaagtatttatcacagtgcctggtacagatgttagcttctgttactactctgattctagcctccctaattctcattcttttttgggggttgcaggggagttcactgtgctgtttgctatatttcaagcctcaaaagacaatgaagttcccaaatgctcttcaaggcagaacaaatataaataatgattctcacaccaaatgtgtgcaaagttcaaatattgcattaatggtgctttttattgtgcaaatcatacgactaacccatcatgtcctttctgtgtcaggaagaacatggatgggaatagaaggatctttgaaatcctaccctctgtgtaaatcagtatctgtgaatttttctcttgttagtactgatttatttactctttctggtgtatctgctctttcccttaaaacctttatgataaaaacatatttgaatgccc

SEQ ID NO: 178 - DNA, 1809 bp, Homo sapiens
ctcagaaggccagaagacggctgtcaaaggtcacagggaaatcaaaggcggggtacagggccagagggaggaggaaacaacttcccggttgctttcagacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtgggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggcaactttttctcagccaggaggagggtgccctgtggcatcattacaagtgtcctggcatgggtaacagccattctggccactttgcctgaatacgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctaaaaaaaaaaaaaa

SEQ ID NO: 179 - DNA, 3756 bp, Homo sapiens
atgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtcccagttccaagcacagagcttccttctgaagaagcaccaactgaaaacagcactggggtccaggactgctaccgaggtgatggacagagttatcgaggcacactctccaccactatcacaggaagaacatgtcagtcttggtcgtctatgacaccacattggcatcggaggatcccattatactatccaaatgctggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaagcaccacctgagaaaagccctgtggtccaggattgctaccatggtgatggacggagttatcgaggcatatcctccaccactgtcacaggaaggacctgtcaatcttggtcatctatgataccacactggcatcagaggaccccagaaaactacccaaatgctggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcatggaggctcattctgaagcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccatggaccccagcatcaggtgggagtactgcaacctgacgcgatgctcagacacagaagggactgtggtcgctcctccgactgtcatccaggttccaagcctagggcctccttctgaacaagactgtatgtttgggaatgggaaaggataccggggcaagaaggcaaccactgttactgggacgccatgccaggaatgggctgcccaggagccccatagacacagcacgttcattccagggacaaataaatgggcaggtctggaaaaaaattactgccgtaaccctgatggtgacatcaatggtccctggtgctacacaatgaatccaagaaaactttttgactactgtgatatccctctctgtgcatcctcttcatttgattgtgggaagcctcaagtggagccgaagaaatgtcctggaagcattgtaggggggtgtgtggcccacccacattcctggccctggcaagtcagtctcagaacaaggtttggaaagcacttctgtggaggcaccttaatatccccagagtgggtgctgactgctgctcactgcttgaagaagtcctcaaggccttcatcctacaaggtcatcctgggtgcacaccaagaagtgaacctcgaatctcatgttcaggaaatagaagtgtctaggctgttcttggagcccacacaagcagatattgccttgctaaagctaagcaggcctgccgtcatcactgacaaagtaatgccagcttgtctgccatccccagactacatggtcaccgccaggactgaatgttacatcactggctggggagaaacccaaggtacctttgggactggccttctcaaggaagcccagctccttgttattgagaatgaagtgtgcaatcactataagtatatttgtgctgagcatttggccagaggcactgacagttgccagggtgacagtggagggcctctggtttgcttcgagaaggacaaatacattttacaaggagtcacttcttggggtcttggctgtgcacgccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttga

SEQ ID NO: 180 - DNA, 6489 bp, Homo sapiens
aggtacctttggggctggctttctcaaggaagcccagctccctgtgattgagaatgaagtgtgcaatcgctatgactgggattgggacacactttctgggcactgctggccagtcccaaaatggaacataaggaagtggttcttctacttcttttatttctgaaatcagcagcacctgagcaaagccatgtggtccaggattgctaccatggtgatggacagagttatcgaggcacgtactccaccactgtcacaggaaggacctgccaagcttggtcatctatgacaccacatcaacataataggaccacagaaaactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtcccagttccaagcacagagcttccttctgaagaagcaccaactgaaaacagcactggggtccaggactgctaccgaggtgatggacagagttatcgaggcacactctccaccactatcacaggaagaacatgtcagtcttggtcgtctatgacaccacattggcatcggaggatcccattatactatccaaatgctggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaagcaccacctgagaaaagccctgtggtccaggattgctaccatggtgatggacggagttatcgaggcatatcctccaccactgtcacaggaaggacctgtcaatcttggtcatctatgataccacactggcatcagaggaccccagaaaactacccaaatgctggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcatggaggctcattctgaagcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccatggaccccagcatcaggtgggagtactgcaacctgacgcgatgctcagacacagaagggactgtggtcgctcctccgactgtcatccaggttccaagcctagggcctccttctgaacaagactgtatgtttgggaatgggaaaggataccggggcaagaaggcaaccactgttactgggacgccatgccaggaatgggctgcccaggagccccatagacacagcacgttcattccagggacaaataaatgggcaggtctggaaaaaaattactgccgtaaccctgatggtgacatcaatggtccctggtgctacacaatgaatccaagaaaactttttgactactgtgatatccctctctgtgcatcctcttcatttgattgtgggaagcctcaagtggagccgaagaaatgtcctggaagcattgtaggggggtgtgtggcccacccacattcctggccctggcaagtcagtctcagaacaaggtttggaaagcacttctgtggaggcaccttaatatccccagagtgggtgctgactgctgctcactgcttgaagaagtcctcaaggccttcatcctacaaggtcatcctgggtgcacaccaagaagtgaacctcgaatctcatgttcaggaaatagaagtgtctaggctgttcttggagcccacacaagcagatattgccttgctaaagctaagcaggcctgccgtcatcactgacaaagtaatgccagcttgtctgccatccccagactacatggtcaccgccaggactgaatgttacatcactggctggggagaaacccaaggtacctttgggactggccttctcaaggaagcccagctccttgttattgagaatgaagtgtgcaatcactataagtatatttgtgctgagcatttggccagaggcactgacagttgccagggtgacagtggagggcctctggtttgcttcgagaaggacaaatacattttacaaggagtcacttcttggggtcttggctgtgcacgccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttga

SEQ ID NO: 181 - DNA, 14905 bp, Homo sapiens
cagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctgattgagcacctgtacggcctgactgtgtttgagaattatctctatgccaccaactcggacaatgccaatgcccagcagaagacgagtgtgatccgtgtgaaccgctttaacagcaccgagtaccaggttgtcacccgggtggacaagggtggtgccctccacatctaccaccagaggcgtcagccccgagtgaggagccatgcctgtgaaaacgaccagtatgggaagccgggtggctgctctgacatctgcctgctggccaacagccacaaggcgcggacctgccgctgccgttccggcttcagcctgggcagtgacgggaagtcatgcaagaagccggagcatgagctgttcctcgtgtatggcaagggccggccaggcatcatccggggcatggatatgggggccaaggtcccggatgagcacatgatccccattgaaaacctcatgaacccccgagccctggacttccacgctgagaccggcttcatctactttgccgacaccaccagctacctcattggccgccagaagattgatggcactgagcgggagaccatcctgaaggacggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtggatgtactggacagactgggaggaggaccccaaggacagtcggcgtgggcggctggagagggcgtggatggatggctcacaccgagacatctttgtcacctccaagacagtgctttggcccaatgggctaagcctggacatcccggctgggcgcctctactgggtggatgccttctacgaccgcatcgagacgatactgctcaatggcacagaccggaagattgtgtatgaaggtcctgagctgaaccacgcctttggcctgtgtcaccatggcaactacctcttctggactgagtatcggagtggcagtgtctaccgcttggaacggggtgtaggaggcgcaccccccactgtgacccttctgcgcagtgagcggccccccatctttgagatccgaatgtatgatgcccagcagcagcaagttggcaccaacaaatgccgggtgaacaatggcggctgcagcagcctgtgcttggccacccctgggagccgccagtgcgcctgtgctgaggaccaggtgttggacgcagacggcgtcacttgcttggcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccatcagcacacctgcccctcggaccgattcaagtgcgagaacaaccggtgcatccccaaccgctggctctgcgacggggacaatgactgtgggaacagtgaagatgagtccaatgccacttgttcagcccgcacctgcccccccaaccagttctcctgtgccagtggccgctgcatccccatctcctggacgtgtgatctggatgacgactgtggggaccgctctgatgagtctgcttcgtgtgcctatcccacctgcttccccctgactcagtttacctgcaacaatggcagatgtatcaacatcaactggagatgcgacaatgacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccaggccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcgaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgccgcagcctggaccccttcaagccgttcatcattttctccaaccgccatgaaatccggcgcatcgatcttcacaaaggagactacagcgtcctggtgcccggcctgcgcaacaccatcgccctggacttccacctcagccagagcgccctctactggaccgacgtggtggaggacaagatctaccgcgggaagctgctggacaacggagccctgactagtttcgaggtggtgattcagtatggcctggccacacccgagggcctggctgtagactggattgcaggcaacatctactgggtggagagtaacctggatcagatcgaggtggccaagctggatgggaccctccggaccaccctgctggccggtgacattgagcacccaagggcaatcgcactggatccccgggatgggatcctgttttggacagactgggatgccagcctgccccgcattgaggcagcctccatgagtggggctgggcgccgcaccgtgcaccgggagaccggctctgggggctggcccaacgggctcaccgtggactacctggagaagcgcatcctttggattgacgccaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatggctcccaatccctgtgaggccaatgggggccagggcccctgctcccacctgtgtctcatcaactacaaccggaccgtgtcctgcgcctgcccccacctcatgaagctccacaaggacaacaccacctgctatgagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggaagctctactggaccgatggtgacaacatcagcatggccaacatggatggcagcaatcgcaccctgctcttcagtggccagaagggccccgtgggcctggctattgacttccctgaaagcaaactctactggatcagctccgggaaccataccatcaaccgctgcaacctggatgggagtgggctggaggtcatcgatgccatgcggagccagctgggcaaggccaccgccctggccatcatgggggacaagctgtggtgggctgatcaggtgtcggaaaagatgggcacatgcagcaaggctgacggctcgggctccgtggtccttcggaacagcaccaccctggtgatgcacatgaaggtctatgacgagagcatccagctggaccataagggcaccaacccctgcagtgtcaacaacggtgactgctcccagctctgcctgcccacgtcagagacgacccgctcctgcatgtgcacagccggctatagcctccggagtggccagcaggcctgcgagggcgtaggttcctttctcctgtactctgtgcatgagggaatcaggggaattcccctggatcccaatgacaagtcagatgccctggtcccagtgtccgggacctcgctggctgtcggcatcgacttccacgctgaaaatgacaccatctactgggtggacatgggcctgagcacgatcagccgggccaagcgggaccagacgtggcgtgaagacgtggtgaccaatggcattggccgtgtggagggcattgcagtggactggatcgcaggcaacatctactggacagaccagggctttgatgtcatcgaggtcgcccggctcaatggctccttccgctacgtggtgatctcccagggtctagacaagccccgggccatcaccgtccacccggagaaagggtacttgttctggactgagtggggtcagtatccgcgtattgagcggtctcggctagatggcacggagcgtgtggtgctggtcaacgtcagcatcagctggcccaacggcatctcagtggactaccaggatgggaagctgtactggtgcgatgcacggacagacaagattgaacggatcgacctggagacaggtgagaaccgcgaggtggttctgtccagcaacaacatggacatgttttcagtgtctgtgtttgaggatttcatctactggagtgacaggactcatgccaacggctctatcaagcgcgggagcaaagacaatgccacagactccgtgcccctgcgaaccggcatcggcgtccagcttaaagacatcaaagtcttcaaccgggaccggcagaaaggcaccaacgtgtgcgcggtggccaatggcgggtgccagcagctgtgcctgtaccggggccgtgggcagcgggcctgcgcctgtgcccacgggatgctggctgaagacggagcatcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaaacgtgggctccgtggaaggcctggcctatcaccgtggctgggacactctctattggacaagctacacgacatccaccatcacgcgccacacagtggaccagacccgcccaggggccttcgagcgtgagaccgtcatcactatgtctggagatgaccacccacgggccttcgttttggacgagtgccagaacctcatgttctggaccaactggaatgagcagcatcccagcatcatgcgggcggcgctctcgggagccaatgtcctgacccttatcgagaaggacatccgtacccccaatggcctggccatcgaccaccgtgccgagaagctctacttctctgacgccaccctggacaagatcgagcggtgcgagtatgacggctcccaccgctatgtgatcctaaagtcagagcctgtccaccccttcgggctggccgtgtatggggagcacattttctggactgactgggtgcggcgggcagtgcagcgggccaacaagcacgtgggcagcaacatgaagctgctgcgcgtggacatcccccagcagcccatgggcatcatcgccgtggccaacgacaccaacagctgtgaactctctccatgccgaatcaacaacggtggctgccaggacctgtgtctgctcactcaccagggccatgtcaactgctcatgccgagggggccgaatcctccaggatgacctcacctgccgagcggtgaattcctcttgccgagcacaagatgagtttgagtgtgccaatggcgagtgcatcaacttcagcctgacctgcgacggcgtcccccactgcaaggacaagtccgatgagaagccatcctactgcaactcccgccgctgcaagaagactttccggcagtgcagcaatgggcgctgtgtgtccaacatgctgtggtgcaacggggccgacgactgtggggatggctctgacgagatcccttgcaacaagacagcctgtggtgtgggcgagttccgctgccgggacgggacctgcatcgggaactccagccgctgcaaccagtttgtggattgtgaggacgcctcagatgagatgaactgcagtgccaccgactgcagcagctacttccgcctgggcgtgaagggcgtgctcttccagccctgcgagcggacctcactctgctacgcacccagctgggtgtgtgatggcgccaatgactgtggggactacagtgatgagcgcgactgcccaggtgtgaaacgccccagatgccctctgaattacttcgcctgccctagtgggcgctgcatccccatgagctggacgtgtgacaaagaggatgactgtgaacatggcgaggacgagacccactgcaacaagttctgctcagaggcccagtttgagtgccagaaccatcgctgcatctccaagcagtggctgtgtgacggcagcgatgactgtggggatggctcagacgaggctgctcactgtgaaggcaagacgtgcggcccctcctccttctcctgccctggcacccacgtgtgcgtccccgagcgctggctctgtgacggtgacaaagactgtgctgatggtgcagacgagagcatcgcagctggttgcttgtacaacagcacttgtgacgaccgtgagttcatgtgccagaaccgccagtgcatccccaagcacttcgtgtgtgaccacgaccgtgactgtgcagatggctctgatgagtcccccgagtgtgagtacccgacctgcggccccagtgagttccgctgtgccaatgggcgctgtctgagctcccgccagtgggagtgtgatggcgagaatgactgccacgaccagagtgacgaggctcccaagaacccacactgcaccagccaagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaagtgccgctgtcgccctggcttccggctgaaggacgacggccggacgtgtgctgatgtggacgagtgcagcaccaccttcccctgcagccagcgctgcatcaacactcatggcagctataagtgtctgtgtgtggagggctatgcaccccgcggcggcgacccccacagctgcaaggctgtgactgacgaggaaccgtttctgatcttcgccaaccggtactacctgcgcaagctcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcaggtcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacgggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaa

SEQ ID NO: 182 - DNA, 15735 bp, Homo sapiens
ggtctaaagggctttatgcactgtctggagggtggggactggcgcgggtagaaaacgggatgcctcgggcgtgggggcaggcttttggccactaggagctggcggaggtgcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccaactcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgacgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgtcctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacagagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcaggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcaatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccggtgctcgtgtgatacaggctacatgttagaaagtgatgggaggacttgcaaagttacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaatgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgtgattataatggacaccatcggagacaggtgatagccagtgatttgattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattccgtgaatccatgtgccttttcccgctgcagccatctctgcctgctttcctcacaggggcctcatttttactcctgtgtttgtccttcaggatggagtctgtctcctgatctcctgaattgcttgagagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccaggtgaaattcacagagtgaagacagatggcaccaacaggacagtatttgcttctatatctatggtggggccttctatgaacctggccttagattggatttcaagaaacctttattctaccaatcctagaactcagtcaatcgaggttttgacactccacggagatatcagatacagaaaaacattgattgccaatgatgggacagctcttggagttggctttccaattggcataactgttgatcctgctcgtgggaagctgtactggtcagaccaaggaactgacagtggggttcctgccaagatcgccagtgctaacatggatggcacatctgtgaaaactctctttactgggaacctcgaacacctggagtgtgtcactcttgacatcgaagagcagaaactctactgggcagtcactggaagaggagtgattgaaagaggaaacgtggatggaacagatcgaatgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacagacgcaatgccgccgaatcctcaaatggctgtagcaacaacatgaatgcctgtcagcagatttgcctgcctgtaccaggaggattgttttcctgcgcctgtgccactggatttaaactcaatcctgataatcggtcctgctctccatataactctttcattgttgtttcaatgctgtctgcaatcagaggctttagcttggaattgtcagatcattcagaaaccatggtgccggtggcaggccaaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggaaatctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgattctttagatataattgcaaggattcgtatcaatggagagaactctgaagtgattcgttatggcagtcgttacccaactccttatggcatcactgtttttgaaaattctatcatatgggtagataggaatttgaaaaagatcttccaagccagcaaggaaccagagaacacagagccacccacagtgataagagacaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggaaagaactgtcatgtctctagactatgacagtgtaagtgatagaatctacttcacacaaaatttagcctctggagttggacagatttcctatgccaccctgtcttcagggatccatactccaactgtcattgcttcaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtacctgtactgggctgactgggatacacatgccaaaatcgagagagccacattgggaggaaacttccgcgtacccattgtgaacagcagtctggtcatgcccagtgggctgactctggactatgaagaggaccttctctactgggtggatgctagtctgcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaaatttgctctcccagcccaggggaatcaacactgttgtgaagaaccagaaacaacagtgtaacaatccttgtgaacagtttaatgggggctgcagccatatctgtgcaccaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtgcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccctgatcgcacttgccagtctggatacacaaaatgtcataattcaaatatttgtattcctcgcgtttatttgtgtgacggagacaatgactgtggagataacagtgatgaaaaccctacttattgcaccactcacacgtgcagcagcagtgagttccaatgcgcatctgggcgctgtattcctcaacattggtattgtgatcaagaaacagattgttttgatgcctctgatgaacctgcctcttgtggtcactctgagcgaacatgcctagctgatgagttcaagtgtgatggtgggaggtgcatcccaagcgaatggatctgtgacggtgataatgactgtggggatatgagtgacgaggataaaaggcaccagtgtcagaatcaaaactgctcggattccgagtttctctgtgtaaatgacagacctccggacaggaggtgcattccccagtcttgggtctgtgatggcgatgtggattgtactgacggctacgatgagaatcagaattgcaccaggagaacttgctctgaaaatgaattcacctgtggttacggactgtgtatcccaaagatattcaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgcaaccacctagatgactgtttggacaacagcgatgagaaaggctgtggcattaatgaatgccatgacccttcaatcagtggctgcgatcacaactgcacagacaccttaaccagtttctattgttcctgtcgtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcaaccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccagaaagctctactggttggatgcccgcctggatggcctctttgtctctgacctcaatggtggacaccgccgcatgctggcccagcactgtgtggatgccaacaacaccttctgctttgataatcccagaggacttgcccttcaccctcaatatgggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattgtgagcaatccctgtggtaccaacaatggtggctgttctcatctctgcctcatcaagccaggaggaaaagggttcacttgcgagtgtccagatgacttccgcacccttcagctgagtggcagcacctactgcatgcccatgtgctccagcacccagttcctgtgcgctaacaatgaaaagtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtgagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcatgagctctgcccatctctgtgacaacttcacagaattcagctgcaaaacaaattaccgctgcatcccaaagtgggccgtgtgcaatggtgtagatgactgcagggacaacagtgatgagcaaggctgtgaggagaggacatgccatcctgtgggggatttccgctgtaaaaatcaccactgcatccctcttcgttggcagtgtgatgggcaaaatgactgtggagataactcagatgaggaaaactgtgctccccgggagtgcacagagagcgagtttcgatgtgtcaatcagcagtgcattccctcgcgatggatctgtgaccattacaacgactgtggggacaactcagatgaacgggactgtgagatgaggacctgccatcctgaatattttcagtgtacaagtggacattgtgtacacagtgaactgaaatgcgatggatccgctgactgtttggatgcgtctgatgaagctgattgtcccacacgctttcctgatggtgcatactgccaggctactatgttcgaatgcaaaaaccatgtttgtatcccgccatattggaaatgtgatggcgatgatgactgtggcgatggttcagatgaagaacttcacctgtgcttggatgttccctgtaattcaccaaaccgtttccggtgtgacaacaatcgctgcatttatagtcatgaggtgtgcaatggtgtggatgactgtggagatggaactgatgagacagaggagcactgtagaaaaccgacccctaaaccttgtacagaatatgaatataagtgtggcaatgggcattgcattccacatgacaatgtgtgtgatgatgccgatgactgtggtgactggtccgatgaactgggttgcaataaaggaaaagaaagaacatgtgctgaaaatatatgcgagcaaaattgtacccaattaaatgaaggaggatttatctgctcctgtacagctgggttcgaaaccaatgtttttgacagaacctcctgtctagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtagctctcctttgttgctactgcctgacaatgtccgaattcgaaaatataatctctcatctgagaggttctcagagtatcttcaagatgaggaatatatccaagctgttgattatgattgggatcccaaggacataggcctcagtgttgtgtattacactgtgcgaggggagggctctaggtttggtgctatcaaacgtgcctacatccccaactttgaatccggccgcaataatcttgtgcaggaagttgacctgaaactgaaatacgtaatgcagccagatggaatagcagtggactgggttggaaggcatatttactggtcagatgtcaagaataaacgcattgaggtggctaaacttgatggaaggtacagaaagtggctgatttccactgacctggaccaaccagctgctattgctgtgaatcccaaactagggcttatgttctggactgactggggaaaggaacctaaaatcgagtctgcctggatgaatggagaggaccgcaacatcctggttttcgaggaccttggttggccaactggcctttctatcgattatttgaacaatgaccgaatctactggagtgacttcaaggaggacgttattgaaaccataaaatatgatgggactgataggagagtcattgcaaaggaagcaatgaacccttacagcctggacatctttgaagaccagttatactggatatctaaggaaaagggagaagtatggaaacaaaataaatttgggcaaggaaagaaagagaaaacgctggtagtgaacccttggctcactcaagttcgaatctttcatcaactcagatacaataagtcagtgcccaacctttgcaaacagatctgcagccacctctgccttctgagacctggaggatacagctgtgcctgtccccaaggctccagctttatagaggggagcaccactgagtgtgatgcagccatcgaactgcctatcaacctgccccccccatgcaggtgcatgcacggaggaaattgctattttgatgagactgacctccccaaatgcaagtgtcctagcggctacaccggaaaatattgtgaaatggcgttttcaaaaggcatctctccaggaacaaccgcagtagctgtgctgttgacaatcctcttgatcgtcgtaattggagctctggcaattgcaggattcttccactatagaaggaccggctcccttttgcctgctctgcccaagctgccaagcttaagcagtctcgtcaagccctctgaaaatgggaatggggtgaccttcagatcaggggcagatcttaacatggatattggagtgtctggttttggacctgagactgctattgacaggtcaatggcaatgagtgaagactttgtcatggaaatggggaagcagcccataatatttgaaaacccaatgtactcagccagagacagtgctgtcaaagtggttcagccaatccaggtgactgtatctgaaaatgtggataataagaattatggaagtcccataaacccttctgagatagttccagagacaaacccaacttcaccagctgctgatggaactcaggtgacaaaatggaatctcttcaaacgaaaatctaaacaaactaccaactttgaaaatccaatctatgcacagatggagaacgagcaaaaggaaagtgttgctgcgacaccacctccatcaccttcgctccctgctaagcctaagcctccttcgagaagagacccaactccaacctattctgcaacagaagacacttttaaagacaccgcaaatcttgttaaagaagactctgaagtatagctataccagctatttagggaataattagaaacacacttttgcacatatattttttacaaacagatgaaaaaagttaacattcagtactttatgaaaaaaatatatttttccctgtttgcctatagttggaggtatcctgtgtgtctttttttacttatgccgtctcatatttttacaaataattatcacaatgtactatatgtatatctttgcactgaagttgtctgaaggtaatactataaatatattgtatatttgtaaattttggaaagattatcctgttactgaatttgctaataaagatgtctgctgatttggttggtgatcattatagtaaatgatccaacaagaaaaggaattgactggggacctttagccgtgtctaaagaagaggcaccactcatatttcctataaaattatctaggaaaggaatccaggccccgctcttgggtccatttttacacattagcacttaattaatgttcaatattacatgtcaatttgattaatggctatgttgataggggccactatgtgttgtatagacatctggacttgactgtagactcctcagataatacagaaggtaggaaaagcaattcagtttggcccttctgtgtgttggcattgtctaaccagaactctctgtttcatgtgtgttctctcactagctgccaagacaacatttttatttgtgatgtctatgaggaaatcccatatcattaagtgccagtgtcctgcattgagtttgtggttaattaaatgagctcttctgctgatggaccctggagcaatttctcccctcacctgacattcaaggtggtcacctgccctagtagttggagctcagtagctgaatttctgaaaccaaatctgtgtcttcataaaataaggtgcaaaaaaaaaaaataccagttaagtaaagcctcaactgggtttttgtttctatgaaaatatcattataatcactatttatttcctaagttgaacctgaatagaaagggaaaccattcttattaagctttttattaggccctgtggctaaatgtgtacatttatattagaatgtactgtacagtccagatcttttctttaattcttattggttttttttttttttttttttttagagatggagtcttgctatattgccaaggctgatcttgaagtcctgggctcaagtgatcctcccacctcagcctcctgagtggttggggttacgggcgtgagccactgtgcctggcttccagctctcctcttaaatagtgggtatagtctgcacaacaggaaccatggcaggaatatacactttcccatagcaaatagcatacctgactctctgtgctaatattgcacatttgttaaacaatgaatgaatggatggatggatggatggatgaatgaatgaaacatatactactgattattttattccagagttctcaaaatatttgttgctgatattttgagtgctgactgtaattactttgattagataaacaactggaaataatgctgctgaaaaagttctaataaatgtgtattttatcaga

SEQ ID NO: 183 - DNA, 1386 bp, Homo sapiens
gccccatctccttgggctgcccgtgcttcgtgctttggactaccgcccagcagtgtcctgccctctgcctgggcctcggtccctcctgcacctgctgcctggatccccggcctgcctgggcctgggccttggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctg

SEQ ID NO: 184 - DNA, 6016 bp, Homo sapiens
accgcggccgcgcgcccccctctgcccccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacatggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaagtatttgggctaaatactctaatggagattgttactgaagccggccccgggagtggtgaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgaattgtggaacaagcaccaggaagtgaaaaagcaaaaagctttggaaaaacagaggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggaagggacaaaggatccatgtgggaccagttagaggatgcagctatggagaccttttctataagcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 185 - DNA, 5973 bp, Homo sapiens
cacgtgcatgtgtagcatgccttggtttttcctttggcatctgaaaaaggcacaacctgaaagacctagaacccagtgtcggtccccaggccctttgggacaggaagagaagagccgtgtggccgcggggaggatgtcctgcggcggggctgtcctcgcggactgactggactccatctcccagcgggcgccgcggcgcggccacgcccccccactccccgcgcgcgcccggtggagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggaatatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacatggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 186 - DNA, 5770 bp, Homo sapiens
accgcggccgcgcgcccccctctgcccccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacatggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaagtatttgggctaaatactctaatggagattgttactgaagccggccccgggagtggtgaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 187 - DNA, 5710 bp, Homo sapiens
accgcggccgcgcgcccccctctgcccccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacatggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 188 - DNA, 5899 bp, Homo sapiens
accgcggccgcgcgcccccctctgcccccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacatggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaagtatttgggctaaatactctaatggagattgttactgaagccggccccgggagtggtgaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 189 - DNA, 5640 bp, Homo sapiens
accgcggccgcgcgcccccctctgcccccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacatggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcagttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 190 - DNA, 5957 bp, Homo sapiens
agtgcagacgcggaactggcgcccgctcggagcggcgccgcgctggggagcgactgacgccccgctgccgggggacgtcgggctgggcctggccagtcccccagagcttgggagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggaatatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaacgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaagtatttgggctaaatactctaatggagattgttactgaagccggccccgggagtggtgaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgaattgtggaacaagcaccaggaagtgaaaaagcaaaaagctttggaaaaacagaggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggaagggacaaaggatccatgtgggaccagttagaggatgcagctatggagaccttttctataagcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcagttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 191 - DNA, 5850 bp, Homo sapiens
agtgcagacgcggaactggcgcccgctcggagcggcgccgcgctggggagcgactgacgccccgctgccgggggacgtcgggctgggcctggccagtcccccagagcttgggagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggaatatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaacgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactcca

SEQ ID NO: 192 - DNA, 6880 bp, Homo sapiens
agccttgagtgtcattcaagggacagcacaacctcatccaagctctcctacctctgcccagccgtccctctcatcctccccattcctcgtccacactccatccaaagaagagggaaagcaccgaatagaggggggcgaaggcaaagtctgctgttcttccccctgggcccccttgctcctccatcctcattctctcaccaccagcccccctaaccccaaggagcccaggaactgaggcgactcgccccactgccatgtccaaaagcttgaaaaagaaaagccactggactagcaaagtccatgagagtgtcattggcaggaacccggagggccagctgggctttgaactgaaggggggcgccgagaatggacagttcccctacctgggggaggtgaagcccggcaaggtggcctatgagagcggcagcaaattggtgtcggaggagctgctgctggaggtgaacgagacccccgtggcggggctcaccatcagggacgtgctggccgtgatcaaacactgcaaggaccccctccggctcaagtgtgtcaagcaaggaggaattgttgataaagaccttcgtcactacctcaacttacgatttcaaaagggttctgtggaccatgagcttcagcaaatcattcgtgacaacctctacctccgcacggtgccatgcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcggaagtgaaagcaaggcaagatgtgaaaccagacatccgacagcctccattcacagactacaggcagcccccgctggattacaggcaacccccaggaggggactaccagcagcccccacccttggactacaggcagcctcccctactggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacgggaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggcccgggggctgcgccggcgtttgccggcccgggcggcggcggcagcggcgcgctggaggccgagggcagggcgggtgcgcgcgcgggtccccggccgggcccgcgacccccggggggcgccccggcgcgcaaggccgccgtcgcgccggggccctggaaggtgccgggttctgacaagctgcccagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcggaaccgttcacccatgacatgtttccatggctcacccttggcatccatcctcggtgttagcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtcttattttaaaccctgtctccatgacttcatttgcactttgacagagcagaggcagagtatttgtcttatatttctcagattataatattaaaaaattacaatcaatttattttcattaaagaacgtgagtctttttagcattcctttctgcttatccttctttccttaccctttgtccttttgtttccattagttttctttcgtcttgtattccttgccactttattttgttagcaacttctagatgtttatcttcatggatctatgattgacctcctagtaaaattctaagtcttgcctttcttccctgctgttttagcatttctttgtaaaatgttagcttcaattaattagccattggtacttactgtagctacacatattaaaaggcaaagtgtttctgaaggcaatttctttttaatatgcccgaatgaatgaggcttcatcctttccatattcttactctttacaggagttcaaatgcaaataagctccacctccctgcacttgtagtctaaaaagtaaaaggggcgatcaggtccatctcaaaggtcacacgtaatagcctccctgggctgatcattccctctccttgtaattgcagtatcctgagtagcagtttaattttcatcaaacatcggagtagtttagttgtttgacaggaggagaataaggctgaaagcctcaagtgaaggatcttgcagcttgtaaaagcaatttccaaaaatgaaacccattcatcgtaaacaaaagcacaaacacttgtagcagtttataatgcttttggtttaatctcaattagtctttctcccctggactagaaatccagtatagtttgccattaatttattgaatctggttttggacaatgcttctgtagtgtagctgcacgtcctggtactgtatcctctgactttattttccatgtattacaaaaggaaaaaaaaattgagattacactggcataaactctagtttgcacagttcacagctactacttgtgcagtaattgctttatgcggctgtaatccataacctgtgaagacagcacatcatctaaatcccattccaaataatatttgtgtagtgttagctgtgaatttaccctgtacagctgtatctctataaatataattccatgtattaatagtcacagaaagactgtaagtgagcaactatttttatgaaacgtaccactatggataaattaacttttacagaaatcttgtttactgtatgatattctaaaacactgtcaaataaaatatatatccaaaaatcttttctttttccaacta

SEQ ID NO: 193 - DNA, 6282 bp, Homo sapiens
tccgggcgcccagactctgagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcggggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcaaaaaaaaaaaaaaaaaa

SEQ ID NO: 194 - DNA, 3155 bp, Homo sapiens
ccgggcgcccagactctgagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcggggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagaagcctagcgtgtctctcaacactggggctgctgcaacaccagaccagtgatctttcctaagcatcgttatacttctaaaaccttcagcattttgcagagctttgcttttcattcctggacatgatgtagaagaaactgagggtagttcttcggggcctatttctgctgatgcctgagcaaacaacctgcttcctcttgtgctctgcagggtttgatggagcctcatttccctttgtgaacacaaagtgcaaaatgaattctttttaattttagtaatttttacaaaggttatctaatgtcttttatttcttgttttctttatgattttatcatttgattcattctcacatttttttcctttaaatatttttagttgacctttttcctttggttttcaaatgttcaacatgaatcagaatagtgtaacaccaaatgagaacatgtgttttcataaaggggttgaggccaccagtactgcagcgaatttccttttcttctccctcctccttccttctctgagcttgcttttagggaaggttaatcttacaggctacctatgtttctctccaccttactaaaatctaaataatgatagatattttaagtttttaaattgagtagttctgagtaatcctagaatatttttccaaattaaataatcctttattatttgcaagttgggccaaatttttttttttttggagacggactcttaacaatctaagattgtttcaacaggactttcttattcccattcctaattttttcaaactaattgcttagatctagaaccagttgagattagtactgtacaatggtatgctttgattgtatttatagaaatataacataaaacatggaccatgttttgaaatcttagaggaattctggtttaaaatctgaaatactttaaagttttctatccttttactgattatgcagcttcttataacccccaaggtacagattatttcagcttaaaagaaataattggcaccatgttctgagaaagattttgagatatacattgttttttgtttttgagacagggtctcactcttgcctaggctggagtgcggtggcgcgatcttggcttactgcaccctctgcctcccaggttcaagtggttctcctgcctcagcctcccaagtagctgggattataggtgtgcgccaccacaccagctaatttttgtatttttagtagagacggggttttactttgttggccaggctggtctcgaactcctgatctcaagtgatccacccgccttggccacccaaagtgctgggattacaggtgtgagacactgtgcctggccagatatacattgttttagatcccctgatacagaactacttttgagatggtaagattagaatatcatgaaagtttaaactgaatccttgcagcgacttccggaatttaggaagcattccctcttctacaggggtctggtcacaagggctggattctctgacaaaaatttcttctatggattctggacagaagacacttgagggtgatatgttttaaaggaaagaggttatgcttatcttcttagcagttgataaaatattaaaactctcttgccatagagaatacaccatcaaagaaaacacaaccctttccctttggtgtacagttatttattaagttgattttggggtttctttcgccagggatcttttcaaaactggtagtagttatttttaaaaatcatgtttgacatctttctattgctcgtaaccagtccctgtagctgtctaagttatgggtggagaagcctgggtatgactttccgttgtgtacactcacacttcatgattgacatttatttattcttttatttccatttggttatgcttatttttgtttgaaatttgtttttttcaaatatgtttcctttttgaacttacagaattgttgaaattttctactaacagccagctaaaatttggtatatgttagctctatctgtttcacttggacgtttcattttgaaagaaagaaattttatgtttcacatatagttttatacaaagtagccagtcccataatgaaatgctgtattgccatagtggtcacacccaagtggtccagtatctcaatggtgaggcagccagactggtcagggctgctttgttgaaatgtgatgattttcatatgccttctttctctttctctctctctttttttttccttttttggcccaatgttgaagatgtagaactttgtttttaaataatgtttttataatttcattcgtatacctaagtttgtattttttgtgactttggacttcaacagtttgtatattgggacttctaatgtgattactgtactaaataaattccactaataaacatcttacattaacaccttaaaaaaaaa

SEQ ID NO: 195 - DNA, 2835 bp, Homo sapiens
ttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaaaaaaaaaaaaaaaaaa

SEQ ID NO: 196 - DNA, 1013 bp, Homo sapiens
ccaagacgagcgcggtcgcggaagtatcgcggcttacatatctcgcagccaggcgggtcctgggagaggcgcgagccaggcctggtcggcgcccgcggagaaaagaagcagtcaagcccatgaactacaaccccggttgccgctttctcctctcctaaccgttaagtgcgctaagggccatggctgaggtgcacgtgatcgggcagatcatgggggccagcggtttctcggaaagtagcctcttctgcaagtggggcattcacacaggggcggcatggaagctcctgtcaggcgtgcgggagggccaaacgcaagtggacaccccgcagataggggacatggcttactggtcccaccccatcgacctgcacttcgccaccaaaggtcttcaaggctggccccggctccatttccaggtgtggtcccaggacagctttggccgctgccagcttgcaggctatggattttgccatgtgcccagtagcccgggcacccaccagctggcctgccccacgtggcggcccctgggcagttggcgagaacagttggcacgggctttcgtgggtggtgggccgcagctgctgcatggggacaccatctacagtggggccgaccgctatcgcctgcacacagctgctggtggcaccgtgcacctggagatcggcctgctgctccgcaacttcgaccgctacggcgtggagtgctgagggactctgcctccaacgtcaccaccatccacaccccggacacccagtgatgggggaggatggcacagtggtcaagagcacagactctagagactgtcagagctgaccccagctaaggcatggcaccgcttctgtcctttctaggacctcggggtccctctgggcccagtttccctatctgtaaattggggacagtaaatgtatggggtcgcagggtgttgagtgacaggaggctgcttagccacatgggaggtgctcagtaaaggagagcaattcttaaaaaaaaaaaaaaaaaaaaaaaaaaaa

SEQ ID NO: 197 - DNA, 12684 bp, Homo sapiens
gcgggcgggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtcttaaaa

SEQ ID NO: 198 - DNA, 3288 bp, Homo sapiens
ccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggttaaaaaaaaaa

SEQ ID NO: 199 - DNA, 3231 bp, Homo sapiens
ccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggttaaaaaaaaaa

SEQ ID NO: 200 - DNA, 3282 bp, Homo sapiens
ccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggttaaaaaaaaaa

SEQ ID NO: 201 - DNA, 3225 bp, Homo sapiens
ccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaaccggcgtatcacacacatctccgcggagcagaagcggcgcttcaacatcaagctggggtttgacacccttcatgggctcgtgagcacactcagtgcccagcccagcctcaaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggttaaaaaaaaaa

SEQ ID NO: 202 - DNA, 1451 bp, Homo sapiens
aacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtgtaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaaa

SEQ ID NO: 203 - DNA, 3842 bp, Homo sapiens
cctgaagggaggatgggctaaggcaggcacacagtggcggagaagatgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggagactgaggcatgccctgtggccctcacttccagacctgcaccgggtcctaggccagtaccttagggacactgcagccctgagcccgcccaaggccacagtctcagatacctgtgaagaagtggaacccagcctccttgaaatcctccccaagtcctcagagaggactcctttgcccctgtgttcctcccaggcccagatggactaccgaagattgcagccttcttgcctggggaccatgcccctgtctgtgtgcccacccatggctgagtcagggtcctgctgtaccacccacattgccaaccattcctacctaccactaagctattggcagcagccttgaggacaggctcctcactcccagttccctggacagagctaaactctcgagacttctctgtgaacttccctaccctacccccacaacacaagcaccccagacctcacctccatccccctctgtctgccctcacaattaggcttcattgcactgatcttactctactgctgctgacataaaaccaggaccctttctccacaggcaggctcatttcactaagctcctcctttactttctctctcctctttgatgtcaaacgccttgaaaacaagcctccacttccccacacttcccatttactcttgagactacttcaattagttcccctactacactttgctagtgaaactgcccaggcaaagtgcacctcaaatcttctaattccaagatccaataggatctcgttaatcatcagttcctttgatctcgctgtaagatttgtcaaggctgactactcacttctcctttaaattctttcctaccttggtcctgcctctttgagtatattagtaggttttttttatttgtttgagacagggtctcactctgtcacccaggctgcagtgcaatggcgcgatctcagctcactgcaacctccacctccgggttcaagcgattcttgtgcctcggcctccctagtagctgggattacaggcgcacaccaccacacacagctaattttttttttttttttttttttttttttttagacggagccttgctctgttgccagactggagtgcagtggcacgatctcggctcactgcaacctctgcctcccgggttcaagccattctgcctcagcctcccaagtagctgggagtacaggcgtctgccaccatgcctaatttttttctatttttaggagagaccggttttcaccacgttggccaggatggtctcgatatcctgatctcgtgatccgcctgcctctgcctcccaaagtgctgggattacaggtgtgacccactgcgcacagccccagctaattttcatatttttagtagagacagggttttgccatgttgcccaggctggtcttgaactcctaacctcgggtgatccacccaccttggcctcccaaagtgttaggattacaggcatgagccactgcgcccggctgagtgtactagtagttaagagaataaactagatctagaatcagagctggattcaattcctgtccttcacatttactagctgtgcaaccttgggcacataacttaatgtctttgagccttagttttttcatctgtaaaacagggataataacagcaccccatagagttgtgacgaggattgagataatctaagtaaagcacagtccctaggacatagtaaatgattcatatatccgaactactgttataattattccttcttactctcctcttctagcatttcttccaattattacagtccttcaagattccatttcttaacagtctccaatcccatctattctctgcctttactatatgttgaccattccaaagttcttatctctagctcagacatctactacagcactgtgatgctttatgcaactaactgtttacatatctgtcccctgctactagattgtgagctccttgagggaaaggaacatgatttatttgtccttttcccccagcacctagagtagtgcttggtgcatgatagtaggccttcaataaattttttctaaatgaatgaaatctttctggacaaggttaccttaatcccatgccagctgtcctcatcctctaaaccgttcataggcagcagtaaatgtgctcagacagttctgattatggactctcctaacacattctaattctcaaacaaatggttttgttgtcattgttttttctggctccaaatatacccactgtatcagtcagggtcttgga

SEQ ID NO: 204 - DNA, 3977 bp, Homo sapiens
cctgaagggaggatgggctaaggcaggcacacagtggcggagaagatgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcggagggacctcttctatgccaacagggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctggtaagaactttcttcctcattcttcccacatagttcccacccccactgaatctgaccctgtgcccaggatccccaactctgacccttctgaccgatggctctggtggcacaatgccttgtgcacagaaggacttaagctgctccctgctgacatccctgtagtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggagactgaggcatgccctgtggccctcacttccagacctgcaccgggtcctaggccagtaccttagggacactgcagccctgagcccgcccaaggccacagtctcagatacctgtgaagaagtggaacccagcctccttgaaatcctccccaagtcctcagagaggactcctttgcccctgtgttcctcccaggcccagatggactaccgaagattgcagccttcttgcctggggaccatgcccctgtctgtgtgcccacccatggctgagtcagggtcctgctgtaccacccacattgccaaccattcctacctaccactaagctattggcagcagccttgaggacaggctcctcactcccagttccctggacagagctaaactctcgagacttctctgtgaacttccctaccctacccccacaacacaagcaccccagacctcacctccatccccctctgtctgccctcacaattaggcttcattgcactgatcttactctactgctgctgacataaaaccaggaccctttctccacaggcaggctcatttcactaagctcctcctttactttctctctcctctttgatgtcaaacgccttgaaaacaagcctccacttccccacacttcccatttactcttgagactacttcaattagttcccctactacactttgctagtgaaactgcccaggcaaagtgcacctcaaatcttctaattccaagatccaataggatctcgttaatcatcagttcctttgatctcgctgtaagatttgtcaaggctgactactcacttctcctttaaattctttcctaccttggtcctgcctctttgagtatattagtaggttttttttatttgtttgagacagggtctcactctgtcacccaggctgcagtgcaatggcgcgatctcagctcactgcaacctccacctccgggttcaagcgattcttgtgcctcggcctccctagtagctgggattacaggcgcacaccaccacacacagctaattttttttttttttttttttttttttttttagacggagccttgctctgttgccagactggagtgcagtggcacgatctcggctcactgcaacctctgcctcccgggttcaagccattctgcctcagcctcccaagtagctgggagtacaggcgtctgccaccatgcctaatttttttctatttttaggagagaccggttttcaccacgttggccaggatggtctcgatatcctgatctcgtgatccgcctgcctctgcctcccaaagtgctgggattacaggtgtgacccactgcgcacagccccagctaattttcatatttttagtagagacagggttttgccatgttgcccaggctggtcttgaactcctaacctcgggtgatccacccaccttggcctcccaaagtgttaggattacaggcatgagccactgcgcccggctgagtgtactagtagttaagagaataaactagatctagaatcagagctggattcaattcctgtccttcacatttactagctgtgcaaccttgggcacataacttaatgtctttgagccttagttttttcatctgtaaaacagggataataacagcaccccatagagttgtgacgaggattgagataatctaagtaaagcacagtccctaggacatagtaaatgattcatatatccgaactactgttataattattccttcttactctcctcttctagcatttcttccaattattacagtccttcaagattccatttcttaacagtctccaatcccatctattctctgcctttactatatgttgaccattccaaagttcttatctctagctcagacatctactacagcactgtgatgctttatgcaactaactgtttacatatctgtcccctgctactagattgtgagctccttgagggaaaggaacatgatttatttgtccttttcccccagcacctagagtagtgcttggtgcatgatagtaggccttcaataaattttttctaaatgaatgaaatctttctggacaaggttaccttaatcccatgccagctgtcctcatcctctaaaccgttcataggcagcagtaaatgtgctcagacagttctgattatggactctcctaacacattctaattctcaaacaaatggttttgttgtcattgttttttctggctccaaatatacccactgtatcagtcagggtcttgga

SEQ ID NO: 205 - DNA, 1785 bp, Homo sapiens
cctgaagggaggatgggctaaggcaggcacacagtggcggagaagatgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggtaccgcccccgccaggcaggagactggcggtggaccaggtggagccgaaggcctgtaaacaggcattcttggttcgctctgtgaccccagatctccgtccaccgcccgtgcgcacctacggcttcgccacttcctgcacgtcacctctgggactcgccgcggctccttacactc

SEQ ID NO: 206 - DNA, 1662 bp, Homo sapiens
acgcgagctgggcagggaagagagcgcccggctcagtactgcgcgcgccctgcggctgtccggggccgcgcggtggccaaagcacagcgcgggagagtctgcgatgtcagagaacggctccttcgccaactgctgcgaggcgggcgggtgggcagtgcgcccgggctggtcgggggctggcagcgcgcggccctccaggacccctcgacctccctgggtggctccagcgctgtccgcggtgctcatcgtcaccaccgccgtggacgtcgtgggcaacctcctggtgatcctctccgtgctcaggaaccgcaagctccggaacgcaggtaatttgttcttggtgagtctggcattggctgacctggtggtggccttctacccctacccgctaatcctcgtggccatcttctatgacggctgggccctgggggaggagcactgcaaggccagcgcctttgtgatgggcctgagcgtcatcggctctgtcttcaatatcactgccatcgccattaaccgctactgctacatctgccacagcatggcctaccaccgaatctaccggcgctggcacacccctctgcacatctgcctcatctggctcctcaccgtggtggccttgctgcccaacttctttgtggggtccctggagtacgacccacgcatctattcctgcaccttcatccagaccgccagcacccagtacacggcggcagtggtggtcatccacttcctcctccctatcgctgtcgtgtccttctgctacctgcgcatctgggtgctggtgcttcaggcccgcaggaaagccaagccagagagcaggctgtgcctgaagcccagcgacttgcggagctttctaaccatgtttgtggtgtttgtgatctttgccatctgctgggctccacttaactgcatcggcctcgctgtggccatcaacccccaagaaatggctccccagatccctgaggggctatttgtcactagctacttactggcttatttcaacagctgcctgaatgccattgtctatgggctcttgaaccaaaacttccgcagggaatacaagaggatcctcttggccctttggaacccacggcactgcattcaagatgcttccaagggcagccacgcggaggggctgcagagcccagctccacccatcattggtgtgcagcaccaggcagatgctctctagcctggatctgaggcacaccagcagcatgacaaactcatgaaatggtgggagagagtctgctgcaagggtgagaccaggcagcctgctgggccacactgtcctgttggcatcacagccccaaggctgggggaacttcatgctgggacaagcagcccatcaacgccatgggttcaggctgatccaggagatgctcacaggccacaggacctggaaaacactcttggtggtgtcttggggatttggtgcacacaagaccaaggaaaggacagaatgaggaaaggcctggggcagaagagcccaactccttctcatagctgaccctcatcctcctgccttggcctcctggctgctttctccccttccccccagcgtggcaggatctcttcctgttagcaaggatgaaagagagaggtcagtaggactggaacttggtaactgcaagggcctcaggtggggcaggtgcagagggc

SEQ ID NO: 207 - DNA, 3274 bp, Homo sapiens
ggagctttctattggtcctgggtaccgagcatgggcgctgcgtcagtgcgcgctggcgcaaggttggtggaagtcgcgttgtgcagtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaggaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtgcaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattacttttttttaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggcataatcttaaaa

SEQ ID NO: 208 - DNA, 3256 bp, Homo sapiens
agtgcgcgctggcgcaaggttggtggaagtcgcgttgtgcaggttcgtgcccggctggcgcggcgtggtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaggaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtgcaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattacttttttttaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggcataatcttaaaa

SEQ ID NO: 209 - DNA, 4225 bp, Homo sapiens
cagtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagaggtgagtcctggactgcgggacacagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcaggtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttc

SEQ ID NO: 210 - DNA, 4217 bp, Homo sapiens
cagtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagaggtgagtcctggacacagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcaggtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttc

SEQ ID NO: 211 - DNA, 4221 bp, Homo sapiens
cagtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagcagcagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcaggtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttc

SEQ ID NO: 212 - DNA, 6157 bp, Homo sapiens
ggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcacttttaataacccacgaccagggcaactgggcaggttattgccaaaccagaatttaccacttgacatcacattgcaaagcccaactggtgctggacctttcccaccaatcagaaacagtagtccctactcagtgatacctcagccaggaatgatgggtaatcaagggatgataggaaaccaaggaaatttagggaacagtagcacaggaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggttaatgatcctgctctgaggggaggcaacctgttcccaaaccagctgcctggaatggatatgattaagcaggagggagacacaacacggaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttttatggttgttttt

SEQ ID NO: 213 - DNA, 4485 bp, Homo sapiens
gtagacagatccaggctcaccagtcctgtgccactgggcttttggcgttctgcacaaggcctacccgcagatgccatgcctgctcccccagcctaatgggctttgatgggggaagagggtggttcagcctctcacgatgaggaggaaagagcaagtgtcctcctcggacattctccgggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtcccccaagctgcatggctgctgggacccccactcgctccacccagcccgagacctgcagagtcaccggccagccattgtcaggaggctccacagccatgtggagaacatgctggacctggcatgggagcggggtttcgtcagccagtatgaatgtgatgaaatcaggttgccgatcttcacaccgtcccagagggcaagaaggctgcttgatcttgccacggtgaaagcgaatggattggctgccttccttctacaacatgttcaggaattaccagtcccattggccctgcctttggaagctgccacatgcaagaagtatatggccaagctgaggaccacggtgtctgctcagtctcgcttcctcagtacctatgatggagcagagacgctctgcctggaggacatatacacagagaatgtcctggaggtctgggcagatgtgggcatggctggacccccgcagaagagcccagccaccctgggcctggaggagctcttcagcacccctggccacctcaatgacgatgcggacactgtgctggtggtgggtgaggcgggcagtggcaagagcacgctcctgcagcggctgcacttgctgtgggctgcagggcaagacttccaggaatttctctttgtcttcccattcagctgccggcagctgcagtgcatggccaaaccactctctgtgcggactctactctttgagcactgctgttggcctgatgttggtcaagaagacatcttccagttactccttgaccaccctgaccgtgtcctgttaacctttgatggctttgacgagttcaagttcaggttcacggatcgtgaacgccactgctccccgaccgaccccacctctgtccagaccctgctcttcaaccttctgcagggcaacctgctgaagaatgcccgcaaggtggtgaccagccgtccggccgctgtgtcggcgttcctcaggaagtacatccgcaccgagttcaacctcaagggcttctctgaacagggcatcgagctgtacctgaggaagcgccatcatgagcccggggtggcggaccgcctcatccgcctgctccaagagacctcagccctgcacggtttgtgccacctgcctgtcttctcatggatggtgtccaaatgccaccaggaactgttgctgcaggagggggggtccccaaagaccactacagatatgtacctgctgattctgcagcattttctgctgcatgccacccccccagactcagcttcccaaggtctgggacccagtcttcttcggggccgcctccccaccctcctgcacctgggcagactggctctgtggggcctgggcatgtgctgctacgtgttctcagcccagcagctccaggcagcacaggtcagccctgatgacatttctcttggcttcctggtgcgtgccaaaggtgtcgtgccagggagtacggcgcccctggaattccttcacatcactttccagtgcttctttgccgcgttctacctggcactcagtgctgatgtgccaccagctttgctcagacacctcttcaattgtggcaggccaggcaactcaccaatggccaggctcctgcccacgatgtgcatccaggcctcggagggaaaggacagcagcgtggcagctttgctgcagaaggccgagccgcacaaccttcagatcacagcagccttcctggcagggctgttgtcccgggagcactggggcctgctggctgagtgccagacatctgagaaggccctgctccggcgccaggcctgtgcccgctggtgtctggcccgcagcctccgcaagcacttccactccatcccgccagctgcaccgggtgaggccaagagcgtgcatgccatgcccgggttcatctggctcatccggagcctgtacgagatgcaggaggagcggctggctcggaaggctgcacgtggcctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtatttgcgcgataacaatatctcagaccgaggcatctgcaagctcattgaatgtgctcttcactgcgagcaattgcagaagttagctctattcaacaacaaattgactgacggctgtgcacactccatggctaagctccttgcatgcaggcagaacttcttggcattgaggctggggaataactacatcactgccgcgggagcccaagtgctggccgaggggctccgaggcaacacctccttgcagttcctgggattctggggcaacagagtgggtgacgagggggcccaggccctggctgaagccttgggtgatcaccagagcttgaggtggctcagcctggtggggaacaacattggcagtgtgggtgcccaagccttggcactgatgctggcaaagaacgtcatgctagaagaactctgcctggaggagaaccatctccaggatgaaggtgtatgttctctcgcagaaggactgaagaaaaattcaagtttgaaaatcctgaagttgtccaataactgcatcacctacctaggggcagaagccctcctgcaggcccttgaaaggaatgacaccatcctggaagtctggctccgagggaacactttctctctagaggaggttgacaagctcggctgcagggacaccagactcttgctttgaagtctccgggaggatgttcgtctcagtttgtttgtgagcaggctgtgagtttgggccccagaggctgggtgacatgtgttggcagcctcttcaaaatgagccctgtcctgcctaaggctgaacttgttttctgggaacaccataggtcacctttattctggcagaggagggagcatcagtgccctccaggatagacttttcccaagcctacttttgccattgacttcttcccaagattcaatcccaggatgtacaaggacagcccctcctccatagtatgggactggcctctgctgatcctcccaggcttccgtgtgggtcagtggggcccatggatgtgcttgttaactgagtgccttttggtggagaggcccggcctctcacaaaagaccccttaccactgctctgatgaagaggagtacacagaacacataattcaggaagcagctttccccatgtctcgactcatccatccaggccattccccgtctctggttcctcccctcctcctggactcctgcacacgctccttcctctgaggctgaaattcagaatattagtgacctcagctttgatatttcacttacagcacccccaaccctggcacccagggtgggaagggctacaccttagcctgccctcctttccggtgtttaagacatttttggaaggggacacgtgacagccgtttgttccccaagacattctaggtttgcaagaaaaatatgaccacactccagctgggatcacatgtggacttttatttccagtgaaatcagttactcttcagttaagcctttggaaacagctcgactttaaaaagctccaaatgcagctttaaaaaattaatctgggccagaatttcaaacggcctcactaggcttctggttgatgcctgtgaactgaactctgacaacagacttctgaaatagacccacaagaggcagttccatttcatttgtgccagaatgctttaggatgtacagttatggattgaaagtttacaggaaaaaaaattaggccgttccttcaaagcaaatgtcttcctggattattcaaaatgatgtatgttgaagcctttgtaaattgtcagatgctgtgcaaatgttattattttaaacattatgatgtgtgaaaactggttaatatttataggtcactttgttttactgtcttaagtttatactcttatagacaacatggccgtgaactttatgctgtaaataatcagaggggaataaactgttgagtcaaaac

SEQ ID NO: 214 - DNA, 4341 bp, Homo sapiens
gaaactaggggcaaggagacgaagagaacatgaaagttaaactttaagatgaagaacaaagctgaacatactgatgcattggatctttggagaggatctcagaactcattgtacttaatttacaggctaaaaccttagaagaggaatttattatatcctacacaagactccagggaagcacatggccttggactgaaggctggcatctggaagctgtcagccaccagcaccttctgcagcaggaaaaggccagggctctgctggagcaggcagcagagtggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggatggctctgtgcggggggacccagccaacgtggagatcaccgagctctgcattcagcacggctggaccccaggaaacggtcgcttcgacgtgctgcccctgctgctgcaggccccagatgatcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctcaaaaaaaaaaaaaaaaaa

SEQ ID NO: 215 - DNA, 4711 bp, Homo sapiens
cttcctgaccggcgcgcgcagcctgctgccgcggtcagcgcctgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaaaaaaaaaa

SEQ ID NO: 216 - DNA, 1301 bp, Homo sapiens
agatatatcatacgaaaatgaaaattataattcttcttggattcctgggagccacattgtcagccccacttatcccacagcgtctcatgtctgccagcaatagcaatgagttacttcttaatcttaataatggtcaacttttgccactacaacttcagggcccacttaattcatggattccacctttctctggaattttacaacagcagcagcaggctcaaattccaggactctcccagttctctttatcagctctagaccagtttgctggactgctcccaaatcagatacccttaacaggagaggccagttttgcccaaggagcccaggcaggccaagttgatcccttacagcttcaaacaccgcctcagacacaaccaggccccagtcacgtgatgccctatgtattctccttcaaaatgcctcaagagcaaggacagatgtttcaatactatccagtttacatggtcctaccctgggaacaacctcagcaaacagttccaaggtcacctcaacaaacaagacagcaacagtatgaggagcagataccattctatgctcaatttggatacattccacaactagcagaacctgctatatcaggaggacagcagcaactagcttttgatccccaactaggcacagctcctgaaattgctgtgatgtcaacaggagaagagataccatatttacaaaaagaagcgatcaactttagacatgacagtgcaggagttttcatgccctcaacttcaccaaaacccagcacaaccaatgttttcacttctgctgtagaccaaactattaccccagagctcccagaagagaaggacaagactgacagcctaagggaaccataagaagttgccctgatcattcagacattttgggaaaaagatgtggccatgccttggatataattttaggctattagcttcctcaatactagtatcagttctttggaatacatgaaatatcttgactcttctcctaaatttgtttttacttatacatgttattaaactctttaaatatgtcatagaaaataatacaatcatgtaatgagtcttgtcttacaaaattatatgtctcttcaaatatcctatcattgtataatatggaatataataacacagaataaagctagtatcattaaatcaattggataattgcattagtaaatgatgcctctgcaaaatggtagtacccatgaagatatgtatattgtcattggatgtatgatgagtgttgtgattggaactgatgaagtaaaataagtatctagatttgaaaaaaaaaaaaaa

SEQ ID NO: 217 - DNA, 924 bp, Homo sapiens
atgaatcacagcgttgtaactgagttcattattctgggcctcaccaaaaagcctgaactccagggaattatcttcctcttttttctcattgtctatcttgtggcttttctcggcaacatgctcatcatcattgccaaaatctataacaacaccttgcatacgcccatgtatgttttccttctgacactggctgttgtggacatcatctgcacaacaagcatcataccgaagatgctggggaccatgctaacatcagaaaataccatttcatatgcaggctgcatgtcccagctcttcttgttcacatggtctctgggagctgagatggttctcttcaccaccatggcctatgaccgctatgtggccatttgtttccctcttcattacagtactattatgaaccaccatatgtgtgtagccttgctcagcatggtcatggctattgcagtcaccaattcctgggtgcacacagctcttatcatgaggttgactttctgtgggccaaacaccattgaccacttcttctgtgagatacccccattgctggctttgtcctgtagccctgtaagaatcaatgaggtgatggtgtatgttgctgatattaccctggccataggggactttattcttacctgcatctcctatggttttatcattgttgctattctccgtatccgcacagtagaaggcaagaggaaggccttctcaacatgctcatctcatctcacagtggtgaccctttactattctcctgtaatctacacctatatccgccctgcttccagctatacatttgaaagagacaaggtggtagctgcactctatactcttgtgactcccacattaaacccgatggtgtacagcttccagaatagggagatgcaggcaggaattaggaaggtgtttgcatttctgaaacactag

SEQ ID NO: 218 - DNA, 3009 bp, Homo sapiens
gtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagagcctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcatgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaaaaaaaaaaaaaa

SEQ ID NO: 219 - DNA, 915 bp, Homo sapiens
atggtttttctttcctccgtagaaactgaccaaaggaaaatgtcagcaggaaaccattcctcagtgactgagttcattctggctgggctctcagaacagccagagctccagctgcgcctcttcctcctgttcttaggaatctatgtggtcacagtggtgggcaacttgagcatgatcacactgattgggctcagttctcacctgcatacccccatgtactatttcctcagtggtctgtccttcattgatatctgccattccactatcattacccccaaaatgctggtgaactttgtgacagagaagaacatcatctcctaccctgaatgcatgactcagctttacttcttcctcatttttgctattgcagagtgtcacatgttggctgtaacggcatatgaccgctatgttgccatctgcagccccttgctgtacaatgtcatcatgtcctatcaccactgcttctggctcacagtgggagtttacattttaggcatccttggatctacaattcacaccggctttatgttgagactctttttgtgcaagactaatgtgattaaccattatttttgtgatctcttccctctcttggggctctcctgctccagcacctacatcaatgaattactggttctggtcttgagtgcatttaacatcctgacgcctgccttaaccatccttgcttcttacatctttatcattgccagcatcctccgcattcgctccactgagggcaggtccaaagccttcagcacttgcagctcccacatcttggctgttgctgttttctttgggtctgcagcattcatgtacctgcagccatcatctgtcagctccatggaccaggggaaagtgtcctctgtgttttatactattgttgtgcccatgctgaacccccaatctatagcctaa

SEQ ID NO: 220 - DNA, 1819 bp, Homo sapiens
ggctgcagggttccccttggcctgcaaacaggaacacagggtgtttctcagtggctgcgagaatgctgatgaaaaccccaggatgttgtgtcaccgtggtggccagctgatagtgccaatcatcccactttgccctgagcactcctgcaggggtagaagactccagaaccttctctcaggcccatggcccaagcagcccatggaacttcataacctgagctctccatctccctctctctcctcctctgttctccctccctccttctctccctcaccctcctctgctccctctgcctttaccactgtgggggggtcctctggagggccctgccaccccacctcttcctcgctggtgtctgccttcctggcaccaatcctggccctggagtttgtcctgggcctggtggggaacagtttggccctcttcatcttctgcatccacacgcggccctggacctccaacacggtgttcctggtcagcctggtggccgctgacttcctcctgatcagcaacctgcccctccgcgtggactactacctcctccatgagacctggcgctttggggctgctgcctgcaaagtcaacctcttcatgctgtccaccaaccgcacggccagcgttgtcttcctcacagccatcgcactcaaccgctacctgaaggtggtgcagccccaccacgtgctgagccgtgcttccgtgggggcagctgcccgggtggccgggggactctgggtgggcatcctgctcctcaacgggcacctgctcctgagcaccttctccggcccctcctgcctcagctacagggtgggcacgaagccctcggcctcgctccgctggcaccaggcactgtacctgctggagttcttcctgccactggcgctcatcctctttgctattgtgagcattgggctcaccatccggaaccgtggtctgggcgggcaggcaggcccgcagagggccatgcgtgtgctggccatggtggtggccgtctacaccatctgcttcttgcccagcatcatctttggcatggcttccatggtggctttctggctgtccgcctgccgatccctggacctctgcacacagctcttccatggctccctggccttcacctacctcaacagtgtcctggaccccgtgctctactgcttctctagccccaacttcctccaccagagccgggccttgctgggcctcacgcggggccggcagggcccagtgagcgacgagagctcctaccaaccctccaggcagtggcgctaccgggaggcctctaggaaggcggaggccatagggaagctgaaagtgcagggcgaggtctctctggaaaaggaaggctcctcccagggctgagggccagctgcagggctgcagcgctgtgggggtaagggctgccgcgctctggcctggagggacaaggccagcacacggtgcctcaaccaactggacaagggatggcggcagaccaggggccaggccaaagcactggcaggactcaggtgggtggcagggagagaaacccacctaggcctctcagtgtgtccaggatggcattcccagaatgcaggggagagcaggatgccgggtggaggagacaggcaaggtgccgttggcacaccagctcagacaggggcctgcgcagctgcaggggacagacgccaatcactgtcacagcagagtcaccttagaaattggacagctgcatgttctgtgctctccagtttgtcccttccaatattaataaacttcccttttaaatataaaaaaaaaaaaaaaaaaaaaaaaaaaaaaaaaaaaaaaaaaaaaaaaaaaaaaaaa

SEQ ID NO: 221 - DNA, 2754 bp, Homo sapiens
atgtgcccgcagctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtagggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcagggagagaacgtgttcttcttggtgaccaacttccttgtgacgccagcccaagttcagggcagatgcccagagcacccgtccgtcccactggctaactgctgggtcgacgaggactgccccgaaggggagggaggcacacacagccacggtgtaaaaacaggccagtgtgtggtgttcaatgggacccacaggacctgtgagatctggagttggtgccccgtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcattgggttcttcaggaccttctatatccctcctcggtaaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagccaccctcaaaaaaaaaaaaaaaaaaaaaaaaaaaaaaaa

SEQ ID NO: 222 - DNA, 11025 bp, Homo sapiens
gagcatcttttggggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtggaaaggggggctcgcccaagaagggtgaagaagcgaagaaagtcgaggcgccgaggctcccaaagctggcagctccgggtggcggtgcaggggcgaagggggggcggggggaaccgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgggcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttctctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgatctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagcctcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattatgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaaagaaaaagaagaaagacacaaagaaaataatctaaacaccaaaaactaaacacaattccaatcctttttctgtacctcacgcgcataaatttgctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgcttcaaaaaaaaaaaaaaaaaaaaaaaaaaaaaaaaaaaaaaaaaaaaaaaaaaaaaaaa

SEQ ID NO: 223 - DNA, 1008 bp, Homo sapiens
ctgaccacagagcgctgctcccgagaaccctgcacccctcaatggagtaaattaccataaagcctcttccttacccatgctttggggtgttaacagctgaggctattcgtcggtgacctgtgggactcgagctattcctgcagctcagcagacctcctggccgtggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 224 - DNA, 1028 bp, Homo sapiens
gggggcgcgtggctgcagcggggcccgcgtggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaaaaaaaaaaaaaaaaaaaaaaaaaaaaaaaaaaaaa

SEQ ID NO: 225 - DNA, 905 bp, Homo sapiens
ggcgaggagaggcacaccactattgttttaatttgcttttacctgattcctggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaaaaaaaaaaaa

SEQ ID NO: 226 - DNA, 1901 bp, Homo sapiens
gtcattcgccgctggactttgacagtggtcaaaggctctgctcagttctctgtgcctgtctccctccagcactgccgaggttctctgccgaggccaaccagaaataccccttggaagctggaatcctgcaacaatggcccagggtgtcctctggatcctactcggattgctactgtggtcagacccagggacagcctccctgcccctgctcatggactctgtcatccaggccctggctgagctggagcagaaagtgccagctgccaagaccagacacacagcttctgcgtggctgatgtcagctccaaactctggcccccacaatcgcctctaccacttcctgctgggggcatggagcctcaatgctacagagttggatccctgcccactaagcccagagctgttaggcctgaccaaggaggtggcccgacatgacgtacgagaagggaaggaatatggggtggtgctggcacctgatggctcgaccgtggctgtggagcctctgctggcggggctggaggcagggctgcaagggcgcagggtcataaatttgcccttggacagcatggctgccccttgggagactggagatacctttccagatgttgtggccattgctccagatgtaagagccacctcctccccaggactcagggatggctctccagatgtcaccactgcagatattggagccaacactccagatgctacaaaaggctgtccagatgtccaagcttccttgccagatgccaaagccaagtccccaccgaccatggtggacagcctcctggcagtcaccctggctggaaacctgggcctgaccttcctccgaggttcccagacccagagccatccagacctgggaactgagggctgctgggaccagctctctgcccctcggacctttacgcttttggaccccaaggcatctctgttaaccatggccttcctcaatggcgccctggatggggtcatccttggagactacctgagccggactcctgagccccggccatccctcagccacttgctgagccagtactatggggctggggtggccagagacccagggttccgcagcaacttccgacggcagaacggtgctgctctgacttcagcctccatcctggcccagcaggtgtggggaacccttgtccttctacagaggctggagccagtacacctccagcttcagtgcatgagccaagaacagctggcccaggtggctgccaatgctaccaaggaattcactgaggccttcctgggatgcccggccatccacccccgctgccgctggggagcggcgccttatcggggccgcccgaagctgctgcagctgccgctgggattcttgtacgtgcatcacacctacgtgcctgcaccaccctgcacggacttcacgcgctgcgcagccaacatgcgctccatgcagcgctaccaccaggacacgcaaggctggggagacatcggctacagtttcgtggtgggctcggacggctacgtgtacgagggacgcggctggcactgggtgggcgcccacacgctcggccacaactcccggggcttcggcgtggccatagtgggcaactacaccgcggcgctgcccaccgaggccgctctgcgcacggtgcgcgacacgctcccgagttgtgcggtgcgcgccggcctcctgcggccagactacgcgctgctgggccaccgccagctggtgcgcaccgactgccccggcgacgcgctcttcgacctgctgcgcacctggccgcacttcaccgcgactgttaagccaagacctgccaggagtgtctctaagagatccaggagggagccacccccaaggaccctgccagccacagacctccaataaagacagcatggaaacaaaaaaaaaaaaaaaaaaaaaa

SEQ ID NO: 227 - DNA, 1716 bp, Homo sapiens
gaggtagggttaggcgcgtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggcaaaaaaaaa

SEQ ID NO: 228 - DNA, 2358 bp, Homo sapiens
aggcgggcggagcgcggttcccggagtctcgcgcccgcggtcatgtgacacagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctcagtacgttgccctctgtgctatcatcttatcatcaattattagacaaatcccactggcctacagtcttgcttctgcagcacccactttgtctcctcaggtagtgatgaattagttgctgtcacaaaaggagggaagtagcacccaaattaagttgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaacaaaaaaaaaaaaaaaaaaaaaaaaaaaa

SEQ ID NO: 229 - DNA, 3273 bp, Homo sapiens
agtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaaaaaagagtcaaaaaaaaaaaaa

SEQ ID NO: 230 - DNA, 6215 bp, Homo sapiens
cccatgagcgcgccgcggcccgggctggcgtgcgggtgcggctgcggcggccgcgcggcggggccccgggaggcgggtcgctgagcggggcgcgcggccccgaggatgcgggagcgggagcgggagcagcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccattcaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacctcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcactcgctgcaggaggtcagcgagcccctcaccgccgcgcgccacgcgcagctgcacaaacggaacagcatcgaggtggccgggctcagccacggcctggagggcctgcggctcaaggagcgcaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgcctcctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctagggggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaaggtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgtgagagtggagttggtcccaactaaagaaaacaacactggttacatcaacgcatcacatattaaggtctctgtcagtggaatcgaatgggattatattgccacacagggaccattacagaatacctgtcaagatttttggcagatggtatgggaacagggaattgcaattatagcaatggtgacagcagaagaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttactgggcaagagaggaccgtctggcacctccaatacacagactggcctgaacatggctgtccagaagacctcaagggatttttatcatatcttgaagagatccagtctgttcgacgccatacaaatagcacaagtgatccccaaagccccaaccctccgttgttggtccactgcagtgctggggtaggaaggactggcgtggtgattttgtcggagatcatgatcgcctgcctggaacacaatgaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatcttaaactaatttttgataatggagtttttattttatgacaaatatttagggatttttctagtgagaaacaactttgtgtaaggatgatccacagatatgagttgctcctatataactttgtatttaaaaatcatgttattatcttttgttattttttaaaaaccttgggtacttaataatggtttagttgccaaactgaaaactatactgagaatctgtgttattttgaaacatcaaaaggatttttctatccagaacattttttatcctaaaaattctatatagttgtaccttctgtttttcaaatgagagctcaattcatttagatactgaaatgagtcagttaatgtaaagttgaggatgaaggcacattatttaaaatgtaagagaataagcattattttttcagtattattcatagatctaaatgaatttgattttattggttgaaaatgaagtgaaaaacaattgcctagggtggttttaagcacttttttgttaaaaacaaatctgagttttaatatatgtgttgctttgtagatgacacaataacaatgggcgctgagaagcgttttgggagagattaaggactaagagtatgtaagatgactaggacaagagtaggtggagtgtgatggtaaatgcaggatgccttcgtctttacaaaaatgcagtattatctatactcagactgaggtgctgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaataattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaattttaaacttttaattgcagttagtgaatatgaaaggatttctgaataaaaatctatccacatta

SEQ ID NO: 231 - DNA, 8022 bp, Homo sapiens
agacgctcgcgagcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccacaggctcccacagcgcctgttccccacacccacatccaacaggcaccggccttgcacccccagcggccgccctcaccgcatcccccgccgcatccctcgccacatcccccgctgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgagagcgggagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctttggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactacaaaaaaaaaaaaaaa

SEQ ID NO: 232 - DNA, 6321 bp, Homo sapiens
gcctccgccctgcgctttgtggagccggagcccagtgacaggcgacggcctcttgccgccccggaccccgggcgcttacctgtggctgctggggtcggccgcccgggaccaggctgggagccccgagaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccacaggctcccacagcgcctgttccccacacccacatccaacaggcaccggccttgcacccccagcggccgccctcaccgcatcccccgccgcatccctcgccacatcccccgctgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgagagcgggagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctttggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactacaaaaaaaaaaaaaaa

SEQ ID NO: 233 - DNA, 8207 bp, Homo sapiens
agacgctcgcgagcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaaggaggtgattgtctaggagtaactgtatgtgcgctcagcaccgggtcacaaccaccgtgggatccacttacagagaagatttgtggagagcttcagcctgtttatggtgttactgagaaaggaattgtggccatttgatataattctggatggaagacctcttatttgtattacattgaattagagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccacaggctcccacagcgcctgttccccacacccacatccaacaggcaccggccttgcacccccagcggccgccctcaccgcatcccccgccgcatccctcgccacatcccccgctgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgagagcgggagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctttggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactacaaaaaaaaaaaaaaa

SEQ ID NO: 234 - DNA, 3312 bp, Homo sapiens
acagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttacggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaatttgaacaaatagctttttaatagatgtaatgatcatatggtgcgtcacctgtgccaaatattcttcaatgaaattatataatgtaactttggacctcagtttttctttagaaatgggtgggagaatgaaaatgcaaatcaggaaaccacattaaagtcaaggaaataaaataatttgaccagaggataaaggacatgagagagtattttaaaactaaagaaaaaattagctgccagaagcaactgaggaccttttttgaaacttgagtagcagtgtaattgagctgagtttgaaagtcctgattcagagagagactgagggttgacaaataaactgtatcaactaaactttgatataaaccagaatgtgctaaatgttttttatgtaaaattgtatatttgttagccattctgtgtctgcagtattgtcataaaattgtcctttcattcttttgaagatattacaaaacaaaaatagttttttttaaattgttttaaactaagatactcaatgatataaaaacatcctgatctgattttacgagaaaaagaaggggaatggtggggaatggtgtgtaccgatatatagtatttctttagacaacttgcagataatttctttattgaaactatcaggaagttttactatgaaattttacatacatgatggaaagtggaagacatataccaattatattccaggaaaaaatacttta

SEQ ID NO: 235 - DNA, 1202 bp, Homo sapiens
tggaaggggaagaggctctggaagggctgatctggggactggggcagggaagcttctgcaaggcttccaggacgtctcccgcgaagcctccccgtgtgtggctgaggatggctgagcagcagggccgggagcttgaggctgagtgccccgtctgctggaaccccttcaacaacacgttccatacccccaaaatgctggattgctgccactccttctgcgtggaatgtctggcccacctcagccttgtgactccagcccggcgccgcctgctgtgcccactctgtcgccagcccacagtgctggcctcagggcagcctgtcactgacttgcccacggacactgccatgctcgccctgctccgcctggagccccaccatgtcatcctggaaggccatcagctgtgcctcaaggaccagcccaagagccgctacttcctgcgccagcctcaagtctacacgctggaccttggcccccagcctgggggccagactgggccgcccccagacacggcctctgccaccgtgtctacgcccatcctcatccccagccaccactctttgagggagtgtttccgcaaccctcagttccgcatctttgcctacctgatggccgtcatcctcagtgtcactctgttgctcatattctccatcttttggaccaagcagttcctttggggtgtggggtgagtgctgttcccagacaagaaaccaaacctttttcggttgctgctgggtatggtgactacggagcctcatttggtattgtcttcctttgtagtgttgtttattttacaatccagggattgttcaggccatgtgtttgcttctgggaacaattttaaaaaaaaacaaaaaaacgaaaagcttgaaggactgggagatgtggagcgacctccgggtgtgagtgtggcgtcatggaagggcagagaagcggttctgaccacagagctccacagcaagttgtgccaaagggctgcacagtggtatccaggaacctgactagcccaaatagcaagttgcatttctcactggagctgcttcaaaatcagtgcatatttttttgagttgctcttttactatgggttgctaaaaaaaaaaaaaaaattgggaagtgagcttcaattctgtgggtaaatgtgtgtttgtttctctttgaatgtcttgccactggttgcagtaaaagtgttctgtattcattaattc

SEQ ID NO: 236 - DNA, 7368 bp, Homo sapiens
caagctttcaagcattcaaaggtctaaatgaaaaaggctaagtattatttcaaaaggcaagtatatcctaatatagcaaaacaaacaaagcaaaatccatcagctactcctccaattgaagtgatgaagcccaaataattcatatagcaaaatggagaaaattagaccggccatctaaaaatctgccattggtgaagtgatgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccaatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcgcaggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcaggaccaacttcagttattcagaaattttttcttaaatagcatttataagtccagagatgaagcaaacaacagtggagtcataaatgaaagctttgaaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaatagcgttgtttgggaaatagagagttgagataaacactctcattcagtagttactgaaagaaaactctgctagaatgataaatgtcatggtggtctataactccaaataaacaatgcaacgttcc

SEQ ID NO: 237 - DNA, 3171 bp, Homo sapiens
ccggccagcgggcgggctccccagccaggccgctgcacctgtcaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaaaaaaaaaaaaaaaaaaaaaaaaaaaaaaaaaaaaaa

SEQ ID NO: 238 - DNA, 1607 bp, Homo sapiens
aatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcaaaa

SEQ ID NO: 239 - DNA, 1588 bp, Homo sapiens
tgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcaaaa

SEQ ID NO: 240 - DNA, 1902 bp, Homo sapiens
tgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcgcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcaaaa

SEQ ID NO: 241 - DNA, 1510 bp, Homo sapiens
atccaccgcaggcttactgtacacatgctagggtccaggacagcaggaccaagccagcagaaacagcctgagcccaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgaccatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaaaattgtcgacttgttttcagggctggatagcccagccatcctcgtcctggtcaactatatcttcttcaaaggcacatggacacagccctttgacctggcaagcaccagggaggagaacttctatgtggacgagacaactgtggtgaaggtgcccatgatgttgcagtcgagcaccatcagttaccttcatgacgcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctgaaaaaaaaaaaaaaaaaaa

SEQ ID NO: 242 - DNA, 1551 bp, Homo sapiens
atcatttgcatgtctagctggagaataaaaataatatatcatttgcatgtcttagtaatgaagtcatgggtgtcgtggcatgagatcagctggagggagaggagagattaaagtgaggagagagctacaaccaagtaagcaagtgtcagggctcaccaaccatgcaaggacagggcaggagaagaggaacctgcaaagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcatctgtcaaaaaaaaaaaa

SEQ ID NO: 243 - DNA, 1851 bp, Homo sapiens
atcatttgcatgtctagctggagaataaaaataatatatcatttgcatgtcttagtaatgaagtcatgggtgtcgtggcatgagatcagctggagggagaggagagattaaagtgaggagagagctacaaccaagtaagcaagtgtcagggctcaccaaccatgcaaggacagggcaggagaagaggaacctgcaaagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcatctgtcaaaaaaaaaaaa

SEQ ID NO: 244 - DNA, 6736 bp, Homo sapiens
atgggcttcttgcccaagcttctcctcctggcctcattcttcccagcaggccaggcctcatggggcgtctccagtccccaggacgtgcagggtgtgaaggggtcttgcctgcttatcccctgcatcttcagcttccctgccgacgtggaggtgcccgacggcatcacggccatctggtactacgactactcgggccagcggcaggtggtgagccactcggcggaccccaagctggtggaggcccgcttccgcggccgcaccgagttcatggggaaccccgagcacagggtgtgcaacctgctgctgaaggacctgcagcccgaggactctggttcctacaacttccgcttcgagatcagtgaggtcaaccgctggtcagatgtgaaaggcaccttggtcacagtaacagaggagcccagggtgcccaccattgcctccccggtggagcttctcgagggcacagaggtggacttcaactgctccactccctacgtatgcctgcaggagcaggtcagactgcagtggcaaggccaggaccctgctcgctctgtcaccttcaacagccagaagtttgagcccaccggcgtcggccacctggagaccctccacatggccatgtcctggcaggaccacggccggatcctgcgctgccagctctccgtggccaatcacagggctcagagcgagattcacctccaagtgaagtatgcccccaagggtgtgaagatcctcctcagcccctcggggaggaacatccttccaggtgagctggtcacactcacctgccaggtgaacagcagctaccctgcagtcagttccattaagtggctcaaggatggggtacgcctccaaaccaagactggtgtgctgcacctgccccaggcagcctggagcgatgctggcgtctacacctgccaagctgagaacggcgtgggctctttggtctcaccccccatcagcctccacatcttcatggctgaggtccaggtgagcccagcaggtcccatcctggagaaccagacagtgacactagtctgcaacacacccaatgaggcacccagtgatctccgctacagctggtacaagaaccatgtcctgctggaggatgcccactcccataccctccggctgcacttggccactagggctgatactggcttctacttctgtgaggtgcagaacgtccatggcagcgagcgctcgggccctgtcagcgtggtagtcaaccacccgcctctcactccagtcctgacagccttcctggagacccaggcgggacttgtgggcatccttcactgctctgtggtcagtgagcccctggccacactggtgctgtcacatgggggtcatatcctggcctccacctccggggacagtgatcacagcccacgcttcagtggtacctctggtcccaactccctgcgcctggagatccgagacctggaggaaactgacagtggggagtacaagtgctcagccaccaactcccttggaaatgcaacctccaccctggacttccatgccaatgccgcccgtctcctcatcagcccggcagccgaggtggtggaaggacaggcagtgacactgagctgcagaagcggcctaagccccacacctgatgcccgcttctcctggtacctgaatggagccctgcttcacgagggtcccggcagcagcctcctgctccccgcggcctccagcactgacgccggctcataccactgccgggcccgggacggccacagtgccagtggcccctcttcgccagctgttctcactgtgctctacccccctcgacaaccaacattcaccaccaggctggaccttgatgccgctggggccggggctggacggcgaggcctccttttgtgccgtgtggacagcgacccccccgccaggctgcagctgctccacaaggaccgtgttgtggccacttccctgccatcagggggtggctgcagcacctgtgggggctgttccccacgcatgaaggtcaccaaagcccccaacttgctgcgtgtggagattcacaaccctttgctggaagaggagggcttgtacctctgtgaggccagcaatgccctgggcaacgcctccacctcagccaccttcaatggccaggccactgtcctggccattgcaccatcacacacacttcaggagggcacagaagccaacttgacttgcaacgtgagccgggaagctgctggcagccctgctaacttctcctggttccgaaatggggtgctgtgggcccagggtcccctggagaccgtgacactgctgcccgtggccagaactgatgctgccctttacgcctgccgcatcctgactgaggctggtgcccagctctccactcccgtgctcctgagtgtactctatcccccggaccgtccaaagctgtcagccctcctagacatgggccagggccacatggctctgttcatctgcactgtggacagccgccccctggccttgctggccttgttccatggggagcacctcctggccaccagcctgggtccccaggtcccatcccatggtcggttccaggctaaagctgaggccaactccctgaagttagaggtccgagaactgggccttggggactctggcagctaccgctgtgaggccacaaatgttcttggatcatccaacacctcactcttcttccaggtccgaggagcctgggtccaggtgtcaccatcacctgagctccaagagggccaggctgtggtcctgagctgccaggtacacacaggagtcccagaggggacctcatatcgttggtatcgggatggccagcccctccaggagtcgacctcggccacgctccgctttgcagccataactttgacacaagctggggcctatcattgccaagcccaggccccaggctcagccaccacgagcctagctgcacccatcagcctccacgtgtcctatgccccacgccacgtcacactcactaccctgatggacacaggccctggacgactgggcctcctcctgtgccgtgtggacagtgaccctccggcccagctgcggctgctccacggggatcgccttgtggcctccaccctacaaggtgtggggggacccgaaggcagctctcccaggctgcatgtggctgtggcccccaacacactgcgtctggagatccacggggctatgctggaggatgagggtgtctatatctgtgaggcctccaacaccctgggccaggcctcggcctcagctgacttcgacgctcaagctgtgaatgtgcaggtgtggcccggggctaccgtgcgggaggggcagctggtgaacctgacctgccttgtgtggaccactcacccggcccagctcacctacacatggtaccaggatgggcagcagcgcctggatgcccactccatccccctgcccaacgtcacagtcagggatgccacctcctaccgctgcggtgtgggcccccctggtcgggcaccccgcctctccagacctatcaccttggacgtcctctacgcgccccgcaacctgcgcctgacctacctcctggagagccatggcgggcagctggccctggtactgtgcactgtggacagccgcccgcccgcccagctggccctcagccacgccggtcgcctcttggcctcctcgacagcagcctctgtccccaacaccctgcgcctggagctgcgagggccacagcccagggatgagggtttctacagctgctctgcccgcagccctctgggccaggccaacacgtccctggagctgcggctggagggtgtgcgggtgatcctggctccggaggctgccgtgcctgaaggtgcccccatcacagtgacctgtgcggaccctgctgcccacgcacccacactctatacttggtaccacaacggtcgttggctgcaggagggtccagctgcctcactctcattcctggtggccacgcgggctcatgcaggcgcctactcttgccaggcccaggatgcccagggcacccgcagctcccgtcctgctgccctgcaagtcctctatgcccctcaggacgctgtcctgtcctccttccgggactccagggccagatccatggctgtgatacagtgcactgtggacagtgagccacctgctgagctggccctatctcatgatggcaaggtgctggccacgagcagcggggtccacagcttggcatcagggacaggccatgtccaggtggcccgaaacgccctacggctgcaggtgcaagatgtgcctgcaggtgatgacacctatgtttgcacagcccaaaacttgctgggctcaatcagcaccatcgggcggttgcaggtagaaggtgcacgcgtggtggcagagcctggcctggacgtgcctgagggcgctgccctgaacctcagctgccgcctcctgggtggccctgggcctgtgggcaactccacctttgcatggttctggaatgaccggcggctgcacgcggagcctgtgcccactctcgccttcacccacgtggctcgtgctcaagctgggatgtaccactgcctggctgagctccccactggggctgctgcctctgctccagtcatgctccgtgtgctctaccctcccaagacgcccaccatgatggtcttcgtggagcctgagggtggcctccggggcatcctggattgccgagtggacagcgagccgctcgccagcctgactctccaccttggcagtcgactggtggcctccagtcagccccagggtgctcctgcagagccacacatccatgtcctggcttcccccaatgccctgagggtggacatcgaggcgctgaggcccagcgaccaaggggaatacatctgttctgcctcaaatgtcctgggctctgcctctacctccacctactttggggtcagagccctgcaccgcctgcatcagttccagcagctgctctgggtcctgggactgctggtgggcctcctgctcctgctgttgggcctgggggcctgctacacctggagaaggaggcgtgtttgtaagcagagcatgggcgagaattcggtggagatggcttttcagaaagagaccacgcagctcattgatcctgatgcagccacatgtgagacctcaacctgtgccccacccctgggctgaccagtggtgttgcctgccctccggaggagaaagtggccagaatctgtgatgactccagcctatgaatgtgaatgaggcagtgttgagtcctgcccgcctctacgaaaacagctctgtgacatctgactttttatgacctggccccaagcctcttgcccccccaaaaatgggtggtgagaggtctgcccaggagggtgttgaccctggaggacactgaagagcactgagctgatctcgctctctcttctctggatctcctcccttctctccatttctccctcaaaggaagccctgccctttcacatccttctcctcgaaagtcaccctggactttggttggattgcagcatcctgcatcctcagaggctcaccaaggcattctgtattcaacagagtatcagtcagcctgctctaacaagagaccaaatacagtgacttcaacatgatagaattttatttttctctcccacgctagtctggctgttacgatggtttatgatgttggggctcaggatccttctatcttccttttctctatccctaaaatgatgcctttgattgtgaggctcaccatggccccgctttgtccacatgccctccagccagaagaaggaagagtggaggtagaagcacacccatgcccatggtggacgcaactcagaagctgcacaggacttttccactcacttcccattggctggagtattgtcacatggctactgcaagctacaagggagactgggaaatgtagtttttattttgagtccagaggacatttggaattggacttccaaaggactcccaactgtgagctcatccctgagacttttgacattgttgggaatgccaccagcaggccatgttttgtctcagtgcccatctactgagggccagggtgtgcccctggccattctggttgtgggcttcctggaagaggtgatcactctcacactaagactgaggaaataaaaaaggtttggtgttttcctagggagagagcatgccaggcagtggagttgcctaagcagacatccttgtgccagatttggcccctgaaagaagagatgccctcattcccaccaccaccccccctacccccagggactgggtactaccttactggcccttacaagagtggagggcagacacagatgttgtcagcatccttattcctgctccagatgcatctctgttcatgactgtgtgagctcctgtccttttcctggagaccctgtgtcgggctgttaaagagaatgagttaccaagaaggaatgacgtgcccctgcgaatcagggaccaacaggagagagctcttgagtgggctagtgactccccctgcagcctggtggagatggtgtgaggagcgaagagccctctgctctaggatttgggttgaaaaacagagagagaagtggggagttgccacaggagctaacacgctgggaggcagttgggggcgggtgaactttgtgtagccgaggccgcaccctccctcattccaggctcattcattttcatgctccattgccagactcttgctgggagcccgtccagaatgtcctcccaataaaactccatcctatgacgcaaaaaaaaaaaaaaaaaa

SEQ ID NO: 245 - DNA, 4064 bp, Homo sapiens
gtagttgagggtggctgtgcaagtcagactcctttccaccaggaaacacagaaaacattctatcttcccaaatgttactctctcagatttgcaccaagaccctagaagtttcttaaatttccatatactttatggacactacaaagcaattccaggaaacactgatacagtagcaaaactactgggagtggaaattggatggagatctgggtcccagttcagagtctgacacctgatttgcaacataattaggcacagggcactcaactattcagggccctaaacccttctattgaaagggaaatgggagaacaatatgtgttcctatggctcagtccctataagattctgtactattcagagttgattttaagtgtcacttaactgaaattatccaacaaaccttcatggcatgaaacattaacacagctctttttatatggcatggttcctatggctcaatccctataagattctgtactattcagagttgattttaaaagtcacttaactgaaattatccaacaaaccctcgaggacattaaacattaacgtggctctttttatatggcatggttcattatcatgccaataaatgattaatcgtaactctctgtcttgaccaataattttgctggacttttgtgattcacaacgtgctctgtgttgtaatgctacctcttgaaactgacatcctagctttattgttttttattacttccctaaggtggctttcaaaagagacaccaagtgacatatttttaggaggggtttaaaagtttgatggggtagaagtaaacgttgcttaactcaaccagcagcagagccagggcccagggaccagcgcttctgtggacttggcctttccagcagcagacccagcaatgaatgatccgaacagctgtgtggacaatgcaacagtttgctctggtgcatcctgtgtggtacctgagagcaatttcaataacatcctaagtgtggtcctaagtacggtgctgaccatcctgttggccttggtgatgttctccatgggatgcaacgtggaaatcaagaaatttctagggcacataaagcggccgtggggcatttgtgttggcttcctctgtcagtttggaatcatgcccctcacaggattcatcctgtcggtggcctttgacatcctcccgctccaggccgtagtggtgctcattataggatgctgccctggaggaactgcctccaatatcttggcctattgggtcgatggcgacatggacctgagcgtcagcatgaccacatgctccacactgcttgccctcggaatgatgccgctgtgcctccttatctataccaaaatgtgggtcgactctgggagcatcgtaattccctatgataacataggtacatctctggttgctctcgttgttcctgtttccattggaatgtttgttaatcacaaatggccccaaaaagcaaagatcatacttaaaattgggtccatcgcgggcgccatcctcattgtgctcatagctgtggttggaggaatattgtaccaaagcgcctggatcattgctcccaaactgtggattataggaacaatatttcctgtggcgggttactccctggggtttcttctggctagaattgctggtctaccctggtacaggtgccgaacggttgcttttgaaacggggatgcagaacacgcagctatgttccaccatcgttcagctctccttcactcctgaggagctcaatgtcgtattcaccttcccgctcatctacagcattttccagctcgcctttgccgcaatattcttaggattttatgtggcatacaagaaatgtcatggaaaaaacaaggcagaaattccagagagcaaagaaaatggaacggagccagagtcatcgttttataaggcaaatggaggatttcaacctgacgaaaagtagacatcaagtggacaaaacagacgagttccaaattacgttcttaaaccgtaactatatttaattatttgttttggtaggacagttggcagaaaagagttaaagtgaaaattggaatttcattggaattcatgtattggtttcagtaccaagtgactggtggcccaattctttaatgggacaaatattgtttcctatatatatgtatatgttttatatatgtatgtatactcatatagatatattgtcattgaaatattcccccaaaatattctcagactaaacctgacatagggaacaccgagaatgaaaacatcgttaacaccaaaactgaattcttatgcagaatttcctagcccatagatgacaacctgactttctgtatgttaaagtagatgtaatgaattattattattacagtggtcacgattttcttcagtgtttatgattataaaaattgacatgaacatctttcactgacattttaatcattattttaaaagctttgcaacctatatatttatataactttgtaatataacatgggcaaatatctgacttctgtatttttaaaaagttgccttctccagtggcagtccaaaagcagaaatgagaggaaattattacaaaatagaattcaataaccatattggatgcaggctcttaactcagcagggatatcgtacatctattgctctacctcaggggtccagtgatacccactagatcttccaaggaaaaacataattctttcaaacggtgtgtatttggcaaagagctcttcaaatctgggagagggacttcctcaaggttttcctgtgtgcagtggatccacatagctaatatgacagctagtcagttgacagggaccacccacagtaagcaccatggtcagggaggtggcaggaggtgcaaagacagaagtattgagagaaacaccaagactctagtggaggaattaattcaatgggagatagtataaaatacatagaaaacacaagtaacagaaacctggttgaaatgcttaactagagtcaattagatgtgcaggagtaagtagtataagaagaatcaagtccgagagtgatcaggaaatgagtattaaacagtatttgaaacagagaacgtgtcccagggcccaaaagtcagaagggccccaccagccaggaaagttgtttcaatgctgtaagtaggtgtagccaagggaagccaggactatctgatatacggtagcaggggtttacggctgccaggggaaaataactcatcaagtgttggactttcaattataagatcgaatttaatttcctttccctcattctgcagcaatcagaatacacaatcttaaccactcggtccttagtggttttgttccattttgcattgggtattttcactgcctcatagagtctatttcaagtgttttggctgaaagggctttttgcatttgcatgttctgagttcagattctgctggtgcacccaagcattatgggaacaggaactcaacttagctcttccagtagaggggtgagggattctgcttttcaaattcataacattgatctttttatgcaagatttccatttacagttgaataagtacttcatatttttccatcattagacaaatacaaaatggactaaataattttaagagatagtggaggagagggggtacagacttccttcttagagagtgtcagagaatatgctcccaatggtggaaaggaagatttacagtctagcggctaagtacctcctacacatttcccatcaatcagaaaatagacaggtacactaaagggaccctgagaactcctcttgtaatttcaacacacccaaaatcaagggcctggatgccagcagctgcagcaagcaggtttttcctccctgttgagcaagacaggtgagcaagataggacttggctttcttacatgatgcggtaacttgtgacttgagtctttttccctaatttgctagtgggaagaaaaatagctgagctttctaaaatgatagctctctatttttaaatgaatttgaaaagtcgattaaattatgtattttattgcctctgagtatcatattaaatgaatattttattttaaaggcttaaataaatgaaaatgatttttgt

SEQ ID NO: 246 - DNA, 3120 bp, Homo sapiens
gacgtcaggtcggaggagtagcacctgccaggagcacgtcccgccggcaggtcgcaggagccctgggagccgccgccatgggtacgctcggcggtttctttggttatcccctgagcatcttcttcatcgtggtcaatgagttttgcgaaagattttcctactatggaatgcgagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagaccattgtgtcgctctccattgtctacacaattggacaagcagtcacctcagtaagctccattaatgacctcacagaccacaaccatgatggcacccccgacagccttcctgtgcacgtggtgctgtccttgatcggcctggccctgatagctctcgggactggaggaatcaaaccctgtgtgtctgcgtttggtggagatcagtttgaagagggccaggagaaacaaagaaacagatttttttccatcttttacttggctattaatgctggaagtttgctttccacaatcatcacacccatgctcagagttcaacaatgtggaattcacagtaaacaagcttgttacccactggcctttggggttcctgctgctctcatggctgtagccctgattgtgtttgtccttggcagtgggatgtacaagaagttcaagccacagggcaacatcatgggtaaagtggccaagtgcatcggttttgccatcaaaaatagatttaggcatcggagtaaggcatttcccaagagggagcactggctggactgggctaaagagaaatacgatgagcggctcatctcccaaattaagatggttacgagggtgatgttcctgtatattccactcccaatgttctgggccttgtttgaccagcagggctccaggtggacactgcaggcaacaactatgtccgggaaaatcggagctcttgaaattcagcccgatcagatgcagaccgtgaacgccatcctgatcgtgatcatggtcccgatcttcgatgctgtgctgtaccctctcattgcaaaatgtggcttcaatttcacctccttgaagaagatggcagttggcatggtcctggcctccatggcctttgtggtggctgccatcgtgcaggtggaaatcgataaaactcttccagtcttccccaaaggaaacgaagtccaaattaaagttttgaatataggaaacaataccatgaatatatctcttcctggagagatggtgacacttggcccaatgtctcaaacaaatgcatttatgacttttgatgtaaacaaactgacaaggataaacatttcttctcctggatcaccagtcactgctgtaactgacgacttcaagcagggccaacgccacacgcttctagtgtgggcccccaatcactaccaggtggtaaaggatggtcttaaccagaagccagaaaaaggggaaaatggaatcagatttgtaaatacttttaacgagctcatcaccatcacaatgagtgggaaagtttatgcaaacatcagcagctacaatgccagcacataccagttttttccttctggcataaaaggcttcacaataagctcaacagagattccgccacaatgtcaacctaatttcaatactttctaccttgaatttggtagtgcttatacctatatagtccaaaggaagaatgacagctgccctgaagtgaaggtgtttgaagatatttcagccaacacagttaacatggctctgcaaatcccgcagtattttcttctcacctgtggcgaagtggtcttctctgtcacgggattggaattctcatattctcaggctccttccaacatgaagtcggtgcttcaggcaggatggctgctgaccgtggctgttggcaacatcattgtgctcatcgtggcaggggcaggccagttcagcaaacagtgggccgagtacattctatttgccgcgttgcttctggtcgtctgtgtaatttttgccatcatggctcggttctatacttacatcaacccagcggagatcgaagctcaatttgatgaggatgaaaagaaaaacagactggaaaagagtaacccatatttcatgtcaggggccaattcacagaaacagatgtgaaggtcaggaggcaagtggaggatggactgggcccgcagatgccctgacctctgcccccaggtagcaggacactccattggatggcccctgatgaggaagacttcagaattgggaactaaaccatgaatgctattttcttttttctttttcttttctttttttttttttttttttttttgagacagagttttgctcttgttgtccaggctggagtgcaatggcacgatctcagctcactgcaacctccgcctcccaggttcaagtaattctcctgcctcagcctcccgagtggctgggattagcggcatgcaccaccacgcccagctatttttgtatttttagtagagatggggtttcaccatgttggccaggatggtctcgatctcttgacctggtgatctgcccacctcggcctgccaaagtgctgggattacaggcttgagctaccgcgcccggccgtgaacgctattttctaagcagccagcagtgaatctaaaactctggaagaagtcttctgtttgaaaggcttatttaagccacacgtacacacactgtcttagagtactgtgagcccaccccacattggtcatcttccctatcacacaaatgatgttattttggactagcttaattttgaaatggtaacaaagtttcctattccatactgttcatttctaatactcttacgaaaactattctaaaggaggcaggagccaaggccaaaagtgaacgtacaggtttgaaatggctgtgataaggaccagctggtattaactgataactttacctttgggtttttgttattttgtttttctagtccctacctgtgtttaaattatggataactcgaaagacagctcaggtgaaggccagtaatgatttttttgaagtttcaatggtgtgaaataaatttctgttctta

SEQ ID NO: 247 - DNA, 1013 bp, Homo sapiens
gacgtcaggtcggaggagtagcacctgccaggagcacgtcccgccggcaggtcgcaggagccctgggagccgccgccatgggtacgctcggcggtttctttggttatcccctgagcatcttcttcatcgtggtcaatgagttttgcgaaagattttcctactatggaatgcgagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagaccattgtgtcgctctccattgtctacacaattggacaagcagtcacctcagtaagctccattaatgacctcacagaccacaaccatgatggcacccccgacagccttcctgtgcacgtggtgctgtccttgatcggcctggccctgatagctctcgggactggaggaatcaaaccctgtgtgtctgcgtttggtggagatcagtttgaagagggccaggagaaacaaagaaacagatttttttccatcttttacttggctattaatgctggaagtttgctttccacaatcatcacacccatgctcagaggtaagagatacctgaaaggaacttctgttggtctttttttagtaaggccaagtccgtgtcttcttcgttttgttctgttcttcccttctgccctgttttctagctgtcagctacatgctgggatgcacgttggaatctggagtaagtgcttccttccctgtgagtttcacctcctttttgtcttatttaaatcccttatcccagtgaccactggagagtctaagccatccttagcatgggcatccatcttcctaaactgttattcatgcaaagtcatgctcgtggtaagaggtaagaggcaagagaggtgccttggaagccaagctggtggccgtagctgccattttagccttcaagctttgctccccagtgatatttctgtgact

SEQ ID NO: 248 - DNA, 625 bp, Homo sapiens
atggaccagtggggggtgtatttcaatcctgtgcttgtttcttttttgtcagagtttctttggttatcccctgagcatcttcttcatcgtggtcaatgagttttgcgaaagattttcctactatggaatgcgagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagaccattgtgtcgctctccattgtctacacaattggacaagcagtcacctcagtaagctccattaatgacctcacagaccacaaccatgatggcacccccgacagccttcctgtgcacgtggtgctgtccttgatcggcctggccctgatagctctcgggactggaggaatcaaaccctgtgtgtctgcgtttggtggagatcagtttgaagagggccaggagaaacaaagaaacagatttttttccatcttttacttggctattaatgctggaagtttgctttccacaatcatcacacccatgctcagaggtaagagatacctgaaaggaacttctgttggtcttttt

SEQ ID NO: 249 - DNA, 2756 bp, Homo sapiens
cacacgcacacatacacagaatcctcagataacaggaggcaataaatccaacagcacatccacgttcagagaacagtgtccctgctgtcttgctaacagctgccaatacctcactgagtgcctcacaccaacatgggctccaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagactacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcagggtccatctgctttgccaacatgggggtggccatcctggagcccacactgcccatctggatgatgcagaccatgtgctcccccaagtggcagctgggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaacaggaggggtgtaatgtgacattgttcatacttgctaataaatacattattgcctaattcagac

SEQ ID NO: 250 - DNA, 2660 bp, Homo sapiens
cacacgcacacatacacagaatcctcagataacaggaggcaataaatccaacagcacatccacgttcagagaacagtgtccctgctgtcttgctaacagctgccaatacctcactgagtgcctcacaccaacatgggctccaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagactacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcaggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaacaggaggggtgtaatgtgacattgttcatacttgctaataaatacattattgcctaattcagac

SEQ ID NO: 251 - DNA, 2214 bp, Homo sapiens
cctgtttcccaggaacggtccccggcttcgcgccccaatttctaacagcctgcctgtcccccgggaacgttctaacatccttggggagcgccccagctacaagacactgtcctgagaacgctgtcatcacccgtagttgcaagtttcggagcggcagtgggaagcatgcgggactacgacgaggtgatcgccttcctgggcgagtgggggcccttccagcgcctcatcttcttcctgctcagcgccagcatcatccccaatggcttcaatggtatgtcagtcgtgttcctggcggggaccccggagcaccgctgtcgagtgccggacgccgcgaacctgagcagcgcctggcgcaacaacagtgtcccgctgcggctgcgggacggccgcgaggtgccccacagctgcagccgctaccggctcgccaccatcgccaacttctcggcgctcgggctggagccggggcgcgacgtggacctggggcagctggagcaggagagctgcctggatggctgggagttcagccaggacgtctacctgtccaccgtcgtgaccgagtggaatctggtgtgtgaggacaactggaaggtgcccctcaccacctccctgttcttcgtaggcgtgctcctcggctccttcgtgtccgggcagctgtcagacaggtttggcaggaagaacgttctcttcgcaaccatggctgtacagactggcttcagcttcctgcagattttctccatcagctgggagatgttcactgtgttatttgtcatcgtgggcatgggccagatctccaactatgtggtagccttcatactaggaacagaaattcttggcaagtcagttcgtattatattctctacattaggagtgtgcacattttttgcagttggctatatgctgctgccactgtttgcttacttcatcagagactggcggatgctgctgctggcgctgacggtgccgggagtgctgtgtgtcccgctgtggtggttcattcctgaatctccccgatggctgatatcccagagaagatttagagaggctgaagatatcatccaaaaagctgcaaaaatgaacaacatagctgtaccagcagtgatatttgattctgtggaggagctaaatcccctgaagcagcagaaagctttcattctggacctgttcaggactcggaatattgccataatgaccattatgtctttgctgctatggatgctgacctcagtgggttactttgctctgtctctggatgctcctaatttacatggagatgcctacctgaactgtttcctctctgccttgattgaaattccagcttacattacagcctggctgctattgcgaaccctgcccaggcgttatatcatagctgcagtactgttctggggaggaggtgtgcttctcttcattcaactggtacctgtggattattacttcttatccattggtctggtcatgctgggaaaatttgggatcacctctgctttctccatgctgtatgtcttcactgctgagctctacccaaccctggtcaggaacatggcggtgggggtcacatccacggcctccagagtgggcagcatcattgccccctactttgtttacctcggtgcttacaacagaatgctgccctacatcgtcatgggtagtctgactgtcctgattggaatcctcaccctttttttccctgaaagtttgggaatgactcttccagaaaccttagagcagatgcagaaagtgaaatggttcagatctgggaaaaaaacaagagactcaatggagacagaagaaaatcccaaggttctaataactgcattctgaaaaaatatctaccccatttggtgaagtgaaaaacagaaaaataagaccctgtggagaaattcgttgttcccactgaaatggactgactgtaacgattgacaccaaaatgaaccttgctatcaagaaatgctcgtcatacagtaaactctggatgattcttccagataatgtccttgctttacaaaccaaccatttctagagagtctccttactcattaattcaatgaaatggattggtaagatgtcttgaaaacatgttagtcaaggactggtaaaatacatataaagattaacactcatttccaatcatacaaatactatccaaataaaaataacatcattgtattaacgcaaatattaggtgacaacaaaaaaaaaaaaaaaaaaaaaaaa

SEQ ID NO: 252 - DNA, 3295 bp, Homo sapiens
cgccttcgccggcgccgctctgcctgccagcggggcgcgccttgcggcccaggcccgcaaccttccctggtcgtgcgccctatgtaaggccagccgcggcaggaccaaggcggcggtgtcagctcgcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgcttgggctggagccggggcgcgacgtggacctggggcagctggagcaggagagctgtctggatggctgggagttcagtcaggacgtctacctgtccaccattgtgaccgagtggaacctggtgtgtgaggacgactggaaggccccactcacaatctccttgttcttcgtgggtgtgctgttgggctccttcatttcagggcagctgtcagacaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctggggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctatgcgtggcactctggtggttcatccctgagtccccccgatggctcatctctcagggacgatttgaagaggcagaggtgatcatccgcaaggctgccaaagccaatgggattgttgtgccttccactatctttgacccgagtgagttacaagacctaagttccaagaagcagcagtcccacaacattctggatctgcttcgaacctggaatatccggatggtcaccatcatgtccataatgctgtggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtgcctacgaccgcttcctgccctacattctcatgggaagtctgaccatcctgacagccatcctcaccttgtttctcccagagagcttcggtaccccactcccagacaccattgaccagatgctaagagtcaaaggaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttacagaggacattaactggatcattgcttccccagggcaggagagcgcagagctagggaaagtgaaaggtaatgaagatggagcagaatgagcagatgcagatcaccagcaaagtgcactgatgtgtgagctcttaagaccactcagcatgacgactgagtagacttgtttacatctgatcaaagcactgggcttgtccaggctcataataaatgctccattgaatctactattcttgttttccactgctgtggaaacctccttgctactatagcgtcttatgtatggtttaaaggaaatttatcaggtgagagagatgagcaacgttgtcttttctctcaaagctgtaatgtgggttttgttttattgtttatttgtttgttgttgtatccttttctccttgttatttgcccttcagaatgcacttgggaaaggctggttccttagcctcctggtttgtgtctttttttttttttttttaaaacagaatcactctggcaattgtctgcagctgccactggtgcaaggccttaccagccctagcctctagcacttctctaagtgccaaaaacagtgtcattgtgtgtgttcctttcttgatacttagtcatgggaggatattacaaaaaagaaatttaaattgtgttcatagtctttcagagtagctcactttagtcctgtaactttattgggtgatattttgtgttcagtgtaattgtcttctctttgctgattatgttaccatggtactcctaaagcatatgcctcacctggttaaaaaagaacaaacatgtttttgtgaaagctactgaagtgccttgggaaatgagaaagttttaataagtaaaatgattttttaaataacaaaaaaaaaaaaaaaa

SEQ ID NO: 253 - DNA, 2401 bp, Homo sapiens
atgatccccgcagccagcagcaccccgccgggagatgccctcttccccagcgtggccccacaggacttctggaggtcccaggtcacgggctactcggggtccgtgacacgacacctcagtcaccgggccaacaacttcaaacgacaccccaagaggaggaagtgcattcgtccctccccacccccgccccccaacaccccgtgcccgcttgagctggtggacttcggggacctgcacccccagaggtccttccgggagctgcttttcaacggctgcattctctttggcatcgagttcagctacgccatggagacggcgtacgtgaccccggtgctcctgcagatgggcctgcccgaccagctctacagcctggtgtggttcatcagccccatcctcggattcctactgcagcctctgttgggtgcttggagtgaccggtgtacctcaaggtttggaaggagacgccctttcattcttgtcctggctataggggcactgctgggcctctcgctcttgctgaatggccgggacattggcatcgccctggctgacgtgaccgggaaccacaagtggggcctgctgctgaccgtgtgcggtgtggtgctgatggactttagcgccgactcggcggacaaccccagccacgcctacatgatggacgtgtgcagccccgcagaccaggaccgaggcctgaacatccacgccctcctggcaggtctcggaggaggctttggatacgtggtcggcggaatccactgggataaaacgggcttcgggagggccctggggggacagctccgagtcatttacctcttcactgcggtcaccctgagcgtcaccaccgtcctgaccctggtcagcatccctgagaggccgctgcggccgccgagtgagaagcgggcagccatgaagagccccagcctcccgctgcccccgtccccacccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccgaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggactggctgcctactggaatgtaaatatgtgataaaataataaatgacagcggcaaagccta

SEQ ID NO: 254 - DNA, 2343 bp, Homo sapiens
gtgaagtatgtttttatgagcaaatttacctttctctccaagttctcccaaatttggaaaccctgagaaaccctgaaaatactctgtcctgggcttatatgccttagacacaactgggattgctgagctcaagggttgcagagcatcctactatgggaagaatgaggacataactcagattgttctggatatttccctcattgctgagaatgcagaatgtttctgaccaagaattgcaagcaagaacaggaaagagtggagtcggccaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttggtaaaaatagttattttttcccacatcctatcagaacaatattattattattattttttattacactttaagttttagggtacatgtgcacaacgtgcaggtttgttacatatgtatacatgtgccatgttggtgtgctgcacccattaactcatcatttaacattaggtgaatctcctaatgctatccctccccccttcccccaccccacaacaggccctggtgtgtgatgttccccttcctgtgtccatgtgcagaacaatattaaatactagataaacaaggtaatattatttcagaaaagcagtctagcaaatgtcccttctgtatgtaaaaagcacgttataaatatgagaatgcagcacacaaagagatagagaatctcttttacttgaaaaggccctgtctgaccttaattacactattctttgtttgaagatttgaaaataaaaaaaaaa

SEQ ID NO: 255 - DNA, 2919 bp, Homo sapiens
tttgaaatagaaaaccaacaactaaatcttctctaacaccatgattttctaatctgtattaaagcgttccaggtatttttgtaatgcaatggatttcaattatgttgttcattttcagcacttacttcaaaagaatgatgctttacaattttgtagttaatttaacatatttttttgtttgcttgaaagggtagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataactttttcttgtctttaagaacctaaaaaacctcttaactcaaaataataaaatgttcactaatgatatttctaaggtatcagtgacacttgagttttcctaggagggacatcaataacagccccctaaagaagattcttagagccagctttatttttatgttgaaacagcaatttcccttaattcatcgaagtaagggtgtacttcctacatctccttctactaatacttctaaaaattttctgttatgaaaacctatttaattccactaaatttgttctttgatattggaattattcagatgcctaaattctcattctgttatgtgaagatttaaatattttattcaagtttatcgcttccatgtgagagaagcctacatcttcttattctatttaggaatcgttctttaactcttcttattcattctaggcatgactcctatataatagattactcataaatataccctcctactttcaattttttcttttctttattactcatacatttgctcaatttgtacagaatactgacaaacttaagcaggttattaaacatcatgaggc

SEQ ID NO: 256 - DNA, 4832 bp, Homo sapiens
ctcgctgctgccttgcagtttgatctcagactgctgtgctagcaatcagcgagactccatgggcgtaggaccctccgagccaggtgcgggatataatcttgtggcgcgccgttttttaagcctgttggaagagcgcagtattcgggtgggagtgacccgattttccaggtgcgtccgtcacccctttctttgactcagaaagggaactccctgaccccttgagcttcccaagtgaggcaatgcctcaccctgctttggcttgcgcacggtgcgcgcacccactgacctgcgcccattgtctggcactccctagtgagatgaacccggtacctcagatggaaatgcagaaatcacccgtcttctgcgtcgctcacgctgggagctgtgcaccggagctgttcctatttggccatcttggctcctctccccttgttcctgattttaatgggactaccttggttatttcacagcacacttacggtgctttgtgaagtgcctgctatgttactatcatcatcttcctgacaagatggtgctgtagaaatctttgcatattgctatgggcttccaagaaaaactacctcgaaggaaaacaaagacaagatgacgatcattctaatgagaagaattataatatgacatgcacactctttacaaagggtagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataactttttcttgtctttaagaacctaaaaaacctcttaactcaaaataataaaatgttcactaatgatatttctaaggtatcagtgacacttgagttttcctaggagggacatcaataacagccccctaaagaagattcttagagccagctttatttttatgttgaaacagcaatttcccttaattcatcgaagtaagggtgtacttcctacatctccttctactaatacttctaaaaattttctgttatgaaaacctatttaattccactaaatttgttctttgatattggaattattcagatgcctaaattctcattctgttatgtgaagatttaaatattttattcaagtttatcgcttccatgtgagagaagcctacatcttcttattctatttaggaatcgttctttaactcttcttattcattctaggcatgactcctatataatagattactcataaatataccctcctactttcaattttttcttttctttattactcatacatttgctcaatttgtacagaatactgacaaacttaagcaggttattaaacatcatgaggcaaagattgttggattttttttcagtaattcaaatccagtgactaaagtttttcttacaaacaagtgtctgaatcaaaggatgaaaggacaatattataaaaactccagttcttaaaggctgtttgtaatgtcagatattgtcaaagaaccactttctaagattcaggactctttagaccgatgtttatatcacccattgtgtcctaaggtagaacacaaacactaattttcccaaaataatcttagacaatagcttctgttatgaaacagaggttagtaaaggctaaggtacatattaaaagctaaatctacttatattattattttgtaaattatggataaaattaaaaattgaaggattttagacatagaagaggacttattgattaatatagggcttctggtaaaagagaatagaatgaacagacaaatacctgtttgtctactccttactctccttcctgttgaaatgacagtcaatatataagaatgacataaatccctaatggatgaagagaatggagtaaggaagggtgggagaagtgggtgtcaatacactatggttatttatgtgtactataaatggagtgagagtgtctgcagggatacaacagagtggaggaagctgaaatacagaatatacctagaaggagcctggaatggaagtgtgaaactgagttgccagttcaaagtgtgagttggtagctggacagaaagcaggccagttaactgaaggactttgtacagatgctttacaggttaatatgatttcctaaatgatcagatgcatcatatgaaaaaagaaagcaaatgagaagagaaaggctgtatagaacaggtttagggggaaggatgaaaagttaagtttcagtttcatgaagtttgagacttcaactctgggcatataaaaaataaccaaggttcaaaccaagactggctttgaaacaagagagaggaactaaaatcattggaaagggggagtttaactttgatgtaggtatgactgcagcagtgagatatcgtattaagatctgatgacatgaaatttggagccacttcctttgtggtgggaggaagtgaggagaatggcctggaaactaaaacaaggagaagagacttacctatattcacagagcagcaagaaaaagtaaacagccactgcatgagaaggtttcaggggaatcagattttgctgagtgtgcgatggtgaagagaatgctcatttctgaactggaatctgagctaaaaagaagcaaataggatatatatggaagttagacttatggaaattagaagaaggggaatgagagatagtttggaattctgtggctatttaggtgactgacataaatgggggcagaggacataatgaggttagttcttacggattcaaggcagatagtgttggtgaaacagtgagtgtcaaaattaggcgaggtggtg

SEQ ID NO: 257 - DNA, 1593 bp, Homo sapiens
gcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagtt

SEQ ID NO: 258 - DNA, 1035 bp, Homo sapiens
gcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgatcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaaaaaaaaaaaa

SEQ ID NO: 259 - DNA, 918 bp, Homo sapiens
gcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgatcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaaaaaaaaaaaa

SEQ ID NO: 260 - DNA, 1911 bp, Homo sapiens
cccttagcaacggcctggcgacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaaaaaaaaaaaaaaaaaaaa

SEQ ID NO: 261 - DNA, 2007 bp, Homo sapiens
cccttagcaacggcctggcgacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaaaaaaaaaaaaaaaaaaaa

SEQ ID NO: 262 - DNA, 1622 bp, Homo sapiens
aaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactgctgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaat

SEQ ID NO: 263 - DNA, 2252 bp, Homo sapiens
aaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgaggtgagtgggcaccccgcgtgcgcaagggccgctatggcccccgcggtggggacggggctggggcctggctgcaccctcgcctcccagcccaggacagccgcttgcggcttttgtgtggaagaggctctgcttctagcgccagcagtgagcaagggggtgcagccctcccatactctcccaacccggggtcacagcaccgcagggaggacagcgggacgcgcgtcccgaggaggccgccccttcctggcctcggtttccagcccgtgttccgtgggatggctgagaggagtacatgggaccctgtccccaacagtggtgcagagggcacgctggacgctgggcagtggccccagtgaggccatacgcataccagaaggtgggcttctcggaccccaggccaacctcctcttcttcctccccagataacgtcctcctctcccagccacccggccaactccttctactacccgcggctgaaggccctgcctcccatcgccagggtgacactgctgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaat

SEQ ID NO: 264 - DNA, 1830 bp, Homo sapiens
aaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactgctgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaat

SEQ ID NO: 265 - DNA, 1643 bp, Homo sapiens
atttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacgatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcgcccccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaactt

SEQ ID NO: 266 - DNA, 1866 bp, Homo sapiens
atggtaaaactacaaaggaaacagattgaagatcaagatagtagttccctgggggctggggtaggagtggagaaagcaggggtggatgggaaaggagccacaggattgggagggccctgctcatgctcttctgaagcaggcgatggcctcgcagaagaagaagaagagcaggtgcccactgatggaggcacatcagcagaagccatgcaggttcccttggaagaagatgatgaattggaggaggaagaaattattaatgatgagaatttcctgggcaagagaccactggatagtcctgaagctgaagaactgccagccatgaagcggcctcggctattaagcactaaaggggacacgctagatgttgtgttattggaagctcgagagccactcagctcaataaatactcaaaagatcccaccaatgctttctccagtccatgtacaggacagtacagacttggcacctccctcacccgagccgccaatgttggctccagttgcaaaatcacaaatgccaactgcaaaaccattagaaacaaagtcatttacacctaaaacaaagactaaaactagctctccaggacagaagactaaatcacctaaaaccgcccagtcaccagcaatggtcggaagtcctattcgatcaccaaaaactgtatccaaagaaaagaaatcacctggacgttccaagagccccaagagtcccaagagccccaaggtcacgactcacattccccaaacacctgtgagacctgaaacgcccaacaggactccttcagctacactcagtgaaaaaatcagtaaagagactatccaggtaaaacaaatacagacaccccctgatgctgggaaactgaacagtgagaatcagccgaaaaaggctgtggtagcagataaaacgattgaggcctctatcgatgctgtgattgcacgagcctgtgctgagcgagagccagatcctttcgaattttcttctggatcggaatctgaaggagacatttttactagccctaagagaatttcaggcccggagtgtactactcccaaagcttccacttccgcgaacaatttcacaaagtcaggatccactcctctgcctctttccggtggaacctcaagttccgataactcatggacaatggatgcctccattgatgaggttgtacgtaaagcaaaactgggaacaccttcaaatatgccccccaactttccttatatctcttctccgtcagtgtctcctcccactcccgaacctctccacaaggtgtatgaggagaaaaccaagctgccttcctccgtggagataaaagtggaaccagtcgctctggccccgagtccagttatccccagattaactctccgagtcggtgctggccaagacaagatactcttggtggcaagtaacagaaatccaaatcaaaccgtcttagaggggaaaacagcaggggtggatgtgacttcggcggggccacctgcaggcttgccaagtatcctagggctctgcccaccctcctcttctcatctggcctctgcggtggcagaggtggtcctggccactcaggctgttgtgattcttggtgctcacagtccctggcgaagccccgcttcccgggcctccgttatcagcccccgtgaaggacttcgcttcagcagcccctgtggtagggaggctgccctgtcagaaggggaagtgtgtggagcacaggctgctccaggtcctctccagctggagccacagtggaaggagcagcccctgtcaggcccccccgaggactcagcagaggtgggggtggggagcgccacctctgaagccgtcagagcttctgccccagcacaggaacaggcaattgaagtcatatttctg

SEQ ID NO: 267 - DNA, 2974 bp, Homo sapiens
gtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccaggcccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggggagatggccattccattctttacgggccgcctcactgactggattctacaagatggctcagccgataccttcactcgaaacttaactctcatgtccattctcaccatagccagtgcagtgctggagttcgtgggtgacgggatctataacaacaccatgggccacgtgcacagccacttgcagggagaggtgtttggggctgtcctgcgccaggagacggagtttttccaacagaaccagacaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtatttcaggtatgctgctgaaagtgggaatcctctacattggtgggcagctggtgaccagtggggctgtaagcagtgggaaccttgtcacatttgttctctaccagatgcagttcacccaggctgtggaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgtaaaaaaaaaaaaaaaaaaaaaaa

SEQ ID NO: 268 - DNA, 1000 bp, Homo sapiens
tcacaaccagtgatattaggcttgcattttctttctttttttctgctcagatatgataacttttctatacatttttttttcaattctaataatggttttatttgttctcggaaactttgccaatggcttcatagcactggtaaatttcattgactgggtgaagagaaaaaagatctcctcagctgaccaaattctcactgctctggcggtctccagaattggtttgctctgggcattattattaaattggtatttaactgtgttgaatccagctttttatagtgtagaattaagaattacttcttataatgcctgggttgtaaccaaccatttcagcatgtggcttgctgctaacctcagcatattttatttgctcaagattgccaatttctccaaccttctttttcttcatttaaagaggagagttaggagtgtcattctggtgatactgttggggactttgatatttttggtttgtcatcttcttgtggcaaacatggatgagagtatgtgggcagaagaatatgaaggaaacatgactgggaagatgaaattgaggaatacagtacatctttcatatttgactgtaactaccctatggagcttcataccctttactctgtccctgatatcttttctgatgctaatctgttctctgtgtaaacatctcaagaagatgcagctccatggagaaggatcgcaagatctcagcaccaaggtccacataaaagctttgcaaactctgatctccttcctcttgttatgtgccattttctttctattcctaatcgtttcggtttggagtcctaggaggctgcggaatgacccggttgtcatggttagcaaggctgttggaaacatatatcttgcattcgactcattcatcctaatttggagaaccaagaagctaaaacacacctttcttttgattttgtgtcagattaggtgctgagtaaaagacctgaaactctcaactctctagattcacaagtgggacatt

SEQ ID NO: 269 - DNA, 3041 bp, Homo sapiens
gcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaataagacatggtttctgccatcaaagatggctggtgggagagagagatacacccttattaagtgctttgtgttagtttattcatagctattgttatatatgtcaaggcaagagaggaccagagcaggacagaggcaatgggtattgaagttgaaggggtacatttgataagagagtcggtattgagaagtttaaatttgtgaatttgaaggctgcgtgggtgtggcaggtaagggaaatgaggtatctgggaaggcttgagtgtaggcaaatttattcatcccaagtcaaactcttgatctctctcacgaaaactatgaccccccctggttgcccctgacctctcaatgttggaacaagccacaaccgtggagttatccttgatgactccccattcattatcccttctgtcccaccaccacagctgtcatctgttcaccagaacgttcttttggttacactccatgtgacatcctgaggctgttgcttctctccagcttttctgttaccatcctggtcctggctactgtcacctagtgggccactataatatggcttcctaatggatcttcctgcttcctctgttgcctcattacttttctatatagcagaatgatcttttgaaaatgtgaaccagatcacattattccctagttaaaaccccccaaggcttcccatcacacttggaataaaatccaaaagaatttttctaaaccaaaaa

SEQ ID NO: 270 - DNA, 3241 bp, Homo sapiens
cgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaaaaa

SEQ ID NO: 271 - DNA, 3365 bp, Homo sapiens
ctggtccgtccaggctccttcccatcctcacacccgcgcctttctccctgcggccccggctcgctgctccagctgcccagctcttcccccgcccggccgcaccataaagcgcccggccgctgccgcggagcccagcagccagctccccagcaccgcacggcggggacgcgagcgcgcccccgacggcagcccggacgccgagcacgggtcacctgcggcgccggcccgggcgccgaccgaggttcaacgcacggcccggggacccccaggcggggccaacgccgccgtcgcccccggcctcgcggggagcaggaagagccaacatgctggccccgcgcggagccgccgtcctcctgctgcacctggtcctgcagcggtggctagcggcaggcgcccaggccaccccccaggtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtgcccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggaataaaaaacattctggacaactgcccaaaatttcccaatcgtgaccaacgggacaaggatggtgatggtgtgggggatgcctgtgacagttgtcctgatgtcagcaaccctaaccagtctgatgtggataatgatctggttggggactcctgtgacaccaatcaggacagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaaaaaaaaaaaa

SEQ ID NO: 272 - DNA, 2837 bp, Homo sapiens
agtctcgcgggaagctccgttgtgggcgccccggctggtggctgagctcaggccttcaggcagaggggaggcgagggcggggcggtcacgtgagagcactgccgcggtgggttgtgggggtgctgcggcgccgtttgctttgccaaaccgacaaaagagagatgatggccaacgacgccaagcccgacgtgaagaccgtgcaggtgctgcgggacacagccaaccgcctgcggatccattccatcagggccacgtgtgcctctggttctggccagctcacgtcgtgctgcagtgcagcggaggtcgtgtctgtcctcttcttccacacgatgaagtataaacagacagacccagaacacccggacaacgaccggttcatcctctccaggggacatgctgctcctatcctctatgctgcttgggtggaggtgggtgacatcagtgaatctgacttgctgaacctgaggaaacttcacagcgacttggagagacaccctaccccccgattgccgtttgttgacgtggcaacagggtccctaggtcagggattaggtactgcatgtggaatggcttatactggcaagtaccttgacaaggccagctaccgggtgttctgccttatgggagatggcgaatcctcagaaggctctgtgtgggaggcttttgcttttgcctcccactacaacttggacaatctcgtggcggtcttcgacgtgaaccgcttgggacaaagtggccctgcaccccttgagcatggcgcagacatctaccagaattgctgtgaagcctttggatggaatacttacttagtggatggccatgatgtggaggccttgtgccaagcattttggcaagcaagtcaagtgaagaacaagcctactgctatagttgccaagaccttcaaaggtcggggtattccaaatattgaggatgcagaaaattggcatggaaagccagtgccaaaagaaagagcagatgcaattgtcaaattaattgagagtcagatacagaccaatgagaatctcataccaaaatcgcctgtggaagactcacctcaaataagcatcacagatataaaaatgacctccccacctgcttacaaagttggtgacaagatagctactcagaaaacatatggtttggctctggctaaactgggccgtgcaaatgaaagagttattgttctgagtggtgacacgatgaactccaccttttctgagatattcaggaaagaacaccctgagcgtttcatagagtgtattattgctgaacaaaacatggtaagtgtggcactaggctgtgctacacgtggtcgaaccattgcttttgctggtgcttttgctgccttttttactagagcattcgatcagctccgaatgggagccatttctcaagccaatatcaaccttattggttcccactgtggggtatccactggagaagatggagtctcccagatggccctggaggatctagccatgttccgaagcattcccaattgtactgttttctatccaagtgatgccatctcgacagagcatgctatttatctagccgccaataccaagggaatgtgcttcattcgaaccagccaaccagaaactgcagttatttataccccacaagaaaattttgagattggccaggccaaggtggtccgccacggtgtcaatgataaagtcacagtaattggagctggagttactctccatgaagccttagaagctgctgaccatctttctcaacaaggtatttctgtccgtgtcatcgacccatttaccattaaacccctggatgccgccaccatcatctccagtgcaaaagccacaggcggccgagttatcacagtggaggatcactacagggaaggtggcattggagaagctgtttgtgcagctgtctccagggagcctgatatccttgttcatcaactggcagtgtcaggagtgcctcaacgtgggaaaactagtgaattgctggatatgtttggaatcagtaccagacacattatagcagccgtaacacttactttaatgaagtaaactaggcttatttctaaaaagtcaagtctattggctttggcccaaaagcactggtatctttgtattaaattcatgtttattgtcacaaaaccattatttatacctatacagttgtactgtttcttttaaagcaaagccatttaacatctttcttcattcctaatttggaaattaaagtttacctttctgttaatctatgtataaatgttactctgagttattaatgtggattttaaaattgtaagcaatagaataggaaataaaacaactacctaatacaaatatttctgataagactacaaatatctgactgagctggggattaaagtagaggtaactgtatcttaaatgagtatgatttccttgtaagttaaaaaaattgaaatttaattgtagacttcaatagtccaagttttgaaggatgtttgagcttttgtataatgccatttatacctgcagttttacagataatgtttgactgcagttgccttggaaattcctccaaagtttgccttcatctctcctctacagtttggaggtgatggtgcagcagtggaacatctcttgatgcaccacactacttgtgttctgtgaagtgatgaaagtataactggttctagtttgcacactacacacatagttttgtgaagcttcagaaatgttttttcttttccttgtggccaaaccagtttgttaatctgattatattcatctgctaatgatactaaagttaatgtaataaagcatttaaaaatcagaaaaaaaaaaaaaaaaaaaaaaaaaaaaaaaaaaaaa

SEQ ID NO: 273 - DNA, 1841 bp, Homo sapiens
atccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcagagttccgatgccctggaagcctgggagaatggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataccccggcaaaaaaaaaaaaaaaaaa

SEQ ID NO: 274 - DNA, 2276 bp, Homo sapiens
cctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataaaaaaaaaaaaaaa

SEQ ID NO: 275 - DNA, 2228 bp, Homo sapiens
cctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataaaaaaaaaaaaaaa

SEQ ID NO: 276 - DNA, 2095 bp, Homo sapiens
cctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctgggactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataaaaaaaaaaaaaaa

SEQ ID NO: 277 - DNA, 3135 bp, Homo sapiens
aaggcaattaaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatcggaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacag

SEQ ID NO: 278 - DNA, 2969 bp, Homo sapiens
aaggcaattaaggcgcccatttcagaagagttacagccgtgaaaattactcagcagtgcagttggctgagaagaggaaaaaaggtcagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatcggaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacag

SEQ ID NO: 279 - DNA, 3003 bp, Homo sapiens
aaggcaattaaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatcggaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacag

SEQ ID NO: 280 - DNA, 2616 bp, Homo sapiens
aaggcaattaaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaaatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatcggaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacag

SEQ ID NO: 281 - DNA, 2232 bp, Homo sapiens
ctctttgcacgtcatttccggcaccggcatggccgggtgagctgcaggctaccttatttaagaccgggaatttagtcagcctggtgagccgactctgaggagatggagtatcgctgaggtgatgagagagaatgtggttgttagcaacatggagagagaaagtgggaagcccgtggctgttgtcgcagttgtgactgagccttggtttacccagcgatacagagaatatctccagaggcagaaactctttgatacacagcaccgtgtggaaaagatgccggatggctcggtggcgctaccggtgctgggagagacgcttccagagcagcacctgcaggagctgaggaatcgtgttgccccaggcagtccctgtatgctcacgcagctcccggatcctgttccttcgaagagggcccagggttgttcacctgcccaaaaattgtgtcttgaggtgagtcgctgggtggagggtcggggagtcaagtggtcagccgagttggaggctgatttgccccgatcatggcaacggcatggtaatctcttgttgctgagtgaagactgtttccaagccaagcagtggaaaaatctgggaccggaactctgggagaccgttgccttggcacttggcgtccagcgtttggcaaaacgagggcgggtatcaccggatggtactcgaactccagcagtgacactgctgctgggtgaccatggctgggtagagcatgtggataatggtatccgttataagtttgacgtgacccagtgtatgttctcctttggaaacatcactgagaagcttcgagtggcatcgttgtcctgtgctggagaagtgctggtggatctctatgcagggattggttattttacattgcctttcctagttcatgctggtgctgccttcgtccatgcttgtgagtggaatccccatgctgtagttgctctgagaaataaccttgagatcaatggagtagcagatcggtgccaaatacactttggagataacagaaaactgaagctctcaaatattgcagatagggtgatcctggggctgattcccagctctgaagaaggctggcccattgcctgccaagtgttaaggcaggatgctggaggcattttgcatatccaccaaaatgtggaatctttcccagggaagaatcttcaggctcttggagtcagcaaagtagagaaagagcattggctgtatcctcagcaaattaccaccaaccaatggaaaaatggagctaccagggattctaggggaaaaatgctgtcaccagccaccaagccagagtggcaaaggtgggcagaatctgcagaaactcgaatcgccactcttcttcagcaggtgcatgggaaaccatggaagacacaaattctgcacatccaaccagtgaaatcctatgctccccatgtggatcacatagtcctggatctggaatgctgcccctgtccttcagttggctagaggaggtagatcctgggacacatgggatccacgtgcgagtggcccttaaatgtatcagttcagtccaggttgtcatcccttttgtcccctggtgatcagtttttttcatattttatagccctgaaagcaggctctagatcaattcaaattatttcatttgtctttcattgataacagaaaatgaaatacctgtttgggagaagcagcatggcccattgaaatgaggctcatctgtgcaattatgaattccaaattctgacctcagttctggaattgaagtttcagtatgttttggcctcgggtttcgttatttgcaaaatgagagtttctttgaactgtctcacgtgactattaagcaactatacacaggacatcggttattttagagtgaaagacacagtgctttttccaaattgctctggctaccatatagaaaattgactgaaggagggccaagatggaaacagagagaccagtgaggaggcttctgtggttgtccaggtctgaggtgatggtaacttggactcggatggtggtaatgggaggtagattgatatgataaataaaattgacagaccaagcaatggaatcagaattaagtccttaacatgaagctgctttgttattatgactgactaaattagagagagaagggaacaaaaattattttagtgtatttccattcccttactgtggcattcctaaatgattgtgaggggttgtcttataaatttggtttgttgtggtagaaaaaaaaaaaaaaa

SEQ ID NO: 282 - DNA, 3519 bp, Homo sapiens
ggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccgtatgtcgaacaatgattggctggagcccacctttcttcttttttgctattagatgggcttgctgctcccgcccatctaattggctttggtctagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcgaaaaaaaaaaaa

SEQ ID NO: 283 - DNA, 3424 bp, Homo sapiens
ggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcgaaaaaaaaaaaa

SEQ ID NO: 284 - DNA, 3949 bp, Homo sapiens
ctcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaagacgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcgaaaaaaaaaaaa

SEQ ID NO: 285 - DNA, 2358 bp, Homo sapiens
gcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaaatgaaaaa

SEQ ID NO: 286 - DNA, 2217 bp, Homo sapiens
gcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaaatgaaaaa

SEQ ID NO: 287 - DNA, 10698 bp, Homo sapiens
atgtccaaggtaacggcgcctgggtccgggccgccggcggcggcgagcgggaaggagaagcgctccttcagcaagcggctgtttcggagcggccgcgctggcggcggcggcgcggggggccccggggcgtccgggccggccgcgccttcctcgccctcctcgccctcctctgcacgctcggtgggcagcttcatgagccgcgttctcaagacgctgtccacgctctcgcaccttagctctgagggcgccgccccagaccgcggcggcctccgcagctgcttcccgcccgggccggccgccgcgcccacgccgccgccgtgcccgccgccgcccgcctctcccgcgccgcccgcttgcgccgccgagccggtgcccggcgtggcggggctccgcaaccacggcaacacgtgcttcatgaacgccacgctgcagtgcctcagcaacaccgagctcttcgccgagtacctggcgctgggccagtaccgggcggggcggcccgagccctcgcctgacccggagcagcctgcgggccgcggcgcgcagggccagggcgaggtcactgagcagctggcgcacctggtgcgggccctctggaccctggagtacaccccgcagcacagccgcgacttcaagactattgtgtcaaagaatgcactgcagtaccggggaaattcccaacatgatgcccaggagtttctgctgtggcttttggaccgagttcatgaagacctcaaccattcagtgaagcagagtggccagcctcctctgaagccaccatcagagactgatatgatgcctgagggaccatctttccctgtctgtagcacttttgtacaagaactctttcaagcgcaatacagatcttctttgacgtgtcctcattgtcagaaacagagcaacacttttgatcctttcctttgcatttctttgccaattcctctgccccacacaaggcctctctatgtcactgtagtgtatcaaggcaaatgttctcactgcatgaggattggtgtggccgtacctctgtctgggactgtcgccagacttcgggaagcagtgtctatggaaacaaagatccccactgatcagattgtgttaacagaaatgtactatgatgggttccatcgttccttttgtgatacagacgacctggaaacagtccatgaaagcgactgcatttttgcctttgagactcccgaaatatttaggcctgaaggaattctcagtcaaagaggaattcatttaaacaacaacctaaaccacttgaaatttggcttggattatcatagactgtcttctcctacacaaacagcagcaaagcaggggaaaatggattctcccacatcaagagcaggcagcgacaagattgtcctgttggtgtgtaaccgagcctgcactgggcaacaagggaaaagatttggactgccttttgtgctgcacttagagaagacaatagcttgggaccttctgcagaaggaaatcttggagaagatgaagtatttcttgaggcccacggtttgcattcaggtgtgtccattcagcttgcgtgtggtcagtgttgttggaataacatatttgctgccccaggaggagcagcccttgtgccacccaatagtagaaagggcattaaaatcttgtggaccaggtggcactgctcatgtgaaattagtagtcgagtgggacaaggagacaagagatttcttatttgtaaatactgaggatgagtatattcctgatgcagaaagtgttcgtctgcaaagggagcgtcatcatcagcctcaaacctgcactttatcccagtgtttccaactgtacaccaaagaggagcggcttgcccccgatgatgcctggcgttgcccacactgtaagcagctgcagcagggaagcattacgttaagcctctggactctgcctgatgtgcttattatacatctaaagagatttcggcaggaaggagacaggcgcatgaaacttcagaacatggtcaaattccccttgactggcctggacatgacacctcacgtggttaagaggagccagagcagctggagtttgccatcgcattggtccccgtggagacggccctatggactcgggagggaccctgaggactacatctatgacctgtatgctgtgtgcaatcaccatggcaccatgcaaggggggcactacacagcgtactgtaagaactctgtggacggcctctggtactgcttcgatgacagcgatgtgcagcagctgtcagaagatgaggtctgcacgcagacagcatacatcctcttctaccagaggcggacagccatcccgtcatggtcagccaacagctcggtggcaggctccacaagttcttccctgtgtgaacactgggtgagccggctcccgggcagcaagccagccagcgtgacctctgcagcttcctccagacgcacctccctggcgtcgctctctgagtccgtggagatgactggagaaaggagtgaagatgatggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtcgccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcaaagtgttttatctgtaaagatgtttatttatttagaacccctgccctcccaccaaagcctcctgtgcttttgttttgtacttttttgagtcacgtgcccgactgtgtgtgtgtgtgtgagtgtatgcgtgtgtgtgtctaattcaattgcaaattgttcaaagcgtcgccttattctgccattgaaccaaataacagccataggcaaaacattgacaccaagctaactggaataattgtagacgatacccaggacggtccctttagcaattgtacatatttctttctagagaactctaatgactttctttggatatgagggttttgaaacctgtgaaccagaaaagctaccattagtgcgtagaaggaggaaggagctgactcgtgtttcttctgagcaggacttgtccttactgtggattgtgggtggcaccaggagctctaaaaactgtgactctaacaacgaaacaaatcgagggaaaaactcttgctttctgcactttcgccccatctaccagtctttgtaaagggcaatattttaacactaatgtttctcaggtatatactcagctagtctaggatggttgcacaccagtaaatggattaaagaggaaggtgccatgtgggtgactgtgtcatttctcctactgccacagatagacattttcgaggtagaaatgaagcctttcaccaccttcctatctgtggtgacatgtgcaccaaaacctgtcttgactcttgggataggtcctaggaagtggcagattggatagccagaaagccagtcactcgtttaattttttttccttctgaaattactagctaaggctcttggaattttgcactgtagtagagcagttaacacctttgacagattcctggaaaaaacttctagattctaaactgggtgaaagactggacatcattttccttgtcaggtgttgcatttttccgttagaggtgggaagctccacgatgccctgtgtctgtgggctcatgttccctcatcttgtagcttggagaggaaagaagttgccttctgccaaaagccaatggtggtatgttgaagcgttgtgtgatcaagtgttacatatgcacttcagatcctgtctgtcagtctctgttagggctgcctttcagtaactcatttattatttcttctttgttcttaagatttcatctcatgcccagaactcacaagcaggttttggagtgtgttccatctggccgtgtcagtgcaaattgcatttcttacaaaggagaacctcaccaaaaaaaacctcacagataagcaaagtatatagttttgcaagctttttcaaggtctcctggcaatactttcctgctcaatttttagcttttcttttttttttaaatgtcaagagagtgaaggtcttgattctctctgaatagcatttgtcactttgccagtaaatacagcatgctaagtttatgtgcttttaaatattagcgtttttcgtcagactcttcaagttcttcttgaacccttggtgcacagatccatatataacctcccttttcagtattgctgtgtgtgaattaactacaacacatatgcatgcatagctgtgaattctgcactactttttttttcttttttccccccaagaatatctcttgggaaaagtttttagtacgttacttaactttattttgctgctaatttgcgcattagccggtaacttgcaagtctggagaccacttactgttgagggtagctggaattttagacccttggcagtatttaagatttagacatttagccttgtgaaagttaccacagtgctccatgtgattcattgactgtgagcctgttgtccattgcactcagccctgtactcacttcttcactcgctgtcctggttttactgttcagattttggtgggttctcaaagcagtaccactctcatctgctcagtacatctgcggcaactggctgccttcgatgctgtcattgcgttcagcccagcacatcacagccccatcagtgtgtagccaccgctctcgtttttctgtatcgcttttatctcctgaaaaagatgcaccaaataagagatcatctatatcaggaattgaatgtctaactcaaacctctcatttttgtttaataggtagatctcatttgaagtctcctatctgaatctctgaaacaattatagtttgattagacaaaggtttttaataacacttcttttttgctgtagtcaagcattaatagaaactagtttaattttcacagtggtaaatatttttattcttgagttatctaggaatggattttccacgatgtctagtgacttaaaaaaaaaaaggaaaaacgtttctacaaatccctttggttttccatgggatctggaataaaatgtcagtgtctataaactgtatgtcatggagtttagtccttgtttcaggtttaatagaaaaaatcaggaagtatcatggcattgtctagacatcatgaagctattttatttccatagttggtaaacagtgaaaatttcattatctccaactactaggtacaactttaggccacaggaaaggttatttggcccgaaagtttggaggtgctccttgaggtgggaagtatcttgtgggaaagtagttacttgattcaatttagttcattggtagggttggggacttggtgttggtttctttctttcttttctttttttttttttttttaattttcccagcaatatttagcacaatgagcgtgtatgtgctttggggttaaaaattatctgctagggatgataggcctgggtttctcgttgacatctagatgggcctgattagagcagtcatctcctggtaggcacaaaataatcaccaacagtaatgttgtatctgtaatgtttgtttgctttttaaagttttattcttgatttcttgtaaacatccattgcactgaggccgtatcattccttaagacagccctacatcttgccttggtaatcccttagataatgtggaaactcaaaccgttaggctccagtcatcttagaccatttcccatccgttttgtattttctcgtcctgaaagcagctgaactgaaagtaagtaataatatgctggaccagtgggaacggatgtgggagtatttgtggtgtgctaaaatactgtaattatctgtgaggctgcctgacacgcttttgcaatcttgttttcatcattcattctgcaaacgtttatggagggccttctttgagcacagaggcaaaactgaaagcttcagggatttgctgtagctgaggagccctgggagcacagcccatcaagcaagggatgtgatggtgtcctaaatggagtgacagttctcctgggaaaagagatcacgtggattccggtcaaatcggctaaggcttgtggttctcttgagcaagtctgttccttctggaaaccaaaagtgcccttcatctttagagacattttactcttccatccaccttttcagactgagctgtctctactatttaggggttgaaaatccattacacagtcactttacgttaacattgggtcatcttatgtttgtatgagacggatgtgggatttgaggggaacattgtcattcccttaaaataactatcatgaaaaaaatagcaacagtatgtaaagggaccaagagtggcagcctttagggaaaatggagcagagaagagctgtgaacaaagctcatttatttgaaataagcgtgctttatttcacatagaggggcatcagacgttacatttcattcggacaaattactgaacagccgaagtgattgtttccaatgtaggttattataattattggatacaaagatttaactagtgtttctgggttggatttttgaaatagtatgcaagtcataagcacagtttcaataaaacacgtattctggaggtgcgtggaactttgtattatttgtagttgagaaaggcaaactttgctgacaaaccagtacctatcacaaacgaacacaaaaagtagctgttactgtgcaggctgtctttaactttcatttcataaagggtacattattgttaaactctactacatggtttggggagaaatccagtggttttatttaaatgaacactctcacactgccttttgatcaactttcaaagtattttgcagatgcattttgagcatgaccatttttttccccaagtaaaaacaattgtgcgtggcctccatataactcagaaagcatgctcttactacctatgcaagcaaacaataaaacatatagacatgaaatgttaagtcttaaaaaaaaaaggcaacaattatggagctctatttttaaatttgtgattttcaaaatatggcttactcatcattgtgtagaagagcatgaatgcgatttcttgttttgctctgcatatatttctctgctgtttttctgatcattggcgagattgtaaagtattttgcaagcagaagtggaattggatatgttgaacacacatcattggtgtacatactgtatttagcctgaagactttcctaaagtgttttgttctaaaaataacctgccattttctatagattttaattttttatatcttcaagggttctattttggtcacaaggaaagaatgtggcttctaatagtgctaagaattaaaagatgcttttatagagacttagagctattttgaaaagctttggggcttcccagccactgatcacaattagactaagcccatggaatttctgggagtgttgtgcagtggattcggttctagatccatcttacatttgtttagtgtttcccaatttttgggagaaggggtgcacagcaaatttgagagacttttttgaatctcacacatgtattttcctcaagattcttttaagcctcttctgaatgacttgtctgagatagtgaagacccacattaactagaatcagctggggaactttaaaaaatacagtgcctgggtcccagtccctagcttttgatctaattcatgtaggggtgggatccaggaattaccatgtattttaaaagcttctgggtgtttctaatttgcagacagattgagaaccactatgatacgtcatccctttactgagaattatggcgagaatcactgccatttgaattactcaggagtgactgattcctcagttgtgtaggagaagcagaaaaaataagaataaaaagaattgagagatactgatatcaaactcccatttgaaatacaagggcccttctgattcaaggcccagttggggagcttggaccatgttgtgaatggcctagcactcgccagtctggtggaaattggtggtcttagttgctggagcaggctgagtgtccccgcggggtttgcatctgtccccagaaccttttccccaggcccgtgggggaatagggaagtcactctgagctagaaattgtcgaagaagaaaagaaacaaccttcctagccttggaaagcctgtccctgcttttgatagaattattgcctttttgtaggaattacagtagcaaaccccaggctgccgctgaatttcctacttttgctcattctctaggatagttcttatccagaatgtggtttcaggaattcttttttttagtttgaaaatgaatgtgaaacattttctttggtgtcttttttttaaaaaaaaaaaacccttattgctattttttcgtgtttttgttttgttttgttttttgtttgttttaccattaagtaatacacatcccagaatttggcactctgtgttaactgtggaggcaaataaaatttagttttaatctgtggtgagctgaatgcactacaacaccttcgaagtaatctgatggtttcattctgtcgagcctcatgctgcctacaaaacaccacaatttacctggtgttttcaacattttaaggaatgaagatacaagtagacatgcaagttggaaatgtttctttagaaaggccatccagaataatgatatctgttgcagtcgtccaaatgcaatatgaaatttcctaggtgctattataaacggtgtggtgtcataccaaatgcaaaagcagttacagtatttccgaagttggagttctctttgtaggcctttcaaatacgtgtttgcattccatagaggtctgctcaccaactgtgcctctcaccactggttaaaattgaatttaagcctcattgacataagtcgtttcttgattgaactcttcagtttttacactggaatttctgtagttgtcttgaaagctgcatgtcacatcactgtacacaaagtgctttggtattactcatgcaccgtggatagtgatttctgtgtcgttttcattttcagttgtacagtaatatggaaggcaggatgtctttcctagaggctggaagaaaagtgtatcgtacattttaaatttattttagaacaagtgcatgagatgtgtcactgatttctgttatttatttgtatgttttattattcaaagtgtatgcacttttaagaagcagaatttatatttttacgtttgaaacgttttatttctgaaacagcgttgattatatagtatacagttggaattaagagaaaagtggaaaatgtaacaaaatacaataaatttattacaagatgtcctcttca

SEQ ID NO: 288 - DNA, 757 bp, Homo sapiens
agatgcgaggtgggcgggggcaggctgaaagttggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatccctataaaaaaaaaaaaaaaa

SEQ ID NO: 289 - DNA, 1678 bp, Homo sapiens
gagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgagtttaaa

SEQ ID NO: 290 - DNA, 2322 bp, Homo sapiens
ggctcggaggctgttcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacggacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaacaaaaaaccacatacaggaaa

SEQ ID NO: 291 - DNA, 2455 bp, Homo sapiens
ggctcggaggctgttcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacggcaggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaacaaaaaaccacatacaggaaa

SEQ ID NO: 292 - DNA, 2452 bp, Homo sapiens
ggctcggaggctgttcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacgggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaacaaaaaaccacatacaggaaa

SEQ ID NO: 293 - DNA, 2580 bp, Homo sapiens
acttccggccccgccccccgaggcggaagcggagtgccaggctactcctcccgcagtgtgggtggttccgaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggtcaccatctcaaggcctgccgagctgtggccttctctgaagatgggcagaagctcattactgtctccaaggacaaagccatccatgttctagatgtggagcagggccaactggaaagacgtgtttccaaggctcatggtgcccccatcaatagtcttctgctggtggatgagaatgttctggccactggggatgacacaggtggtatccgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaatgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccaggcaagagtcttgcttattgggctgcatccccagagaggatatgaattattttttgaaaagacagggttttgccatcgtccaggctggagtgcgctggcttgatcttggctcactgcagcctcaatgtccccaggctcagattgtccttccaccttagcctctggagcagctgggactacaggtgtgcactaccacaccaggccaatttttgttttttttttttggtagaaacgggtctgttttgcccaggctggtcttcaactcctggactcaaatgatccacctgcctctgcttcccaaagtgctgggattacaggcacgagccaccacacctggccaaaaaaatttatattttttgagacaaggtctcactctgtcacccaggctggagtacagtgggttgatcatggctcactgcatccttgacttcctgggctcaagtgatccacctcagcctgcctggtagctgagacttaacaggcatctgccaccatgcttgactaatttttgtgatttttttttggtagagaccaggggtttcactatgttgaccaagctggtcttggaactcctgggctcaagtgatcctcctgccttggcctcccaaaatgctgggattacaggcatgagccactgtgcctggctggatatgaaattttttttttttttttttttgagacagggtttcgctcttgttgccagggctggagtgcaatggcgtgatcttggctcactgcaacctccgcctcccgggttcaagcaattctcctgcctcagcctcccaagtagctgggattacaggtgtctgccaccatgccaggctaatttttgtattttcagtagagacggggtttctccatgctggccaggctggtctcgaactcctgacctcaggtgatccacccgcctcagcctcccaaagtgctgggattacaggcaaaagccaacacacccggcctggatatgaatttataataccctacagtgcaacacaagaagatgcactcaaagcactgatgtgaggaagtacttgccccgtagcagctattcactctaccagtgtaaacaaactctaagctagggcaagacagcacagacacaagtatatactaaccaggggtttaatataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaa

SEQ ID NO: 294 - DNA, 5765 bp, Homo sapiens
cagccgcccctcctgcggccgctgcgggggccgccgcctgacttcggacaccggccccgcacccgccaggaggggagggaaggggaggcggggagagcgacggcggggggcgggcggtggaccccgcctcccccggcacagcctgctgaggggaagagggggtctccgctcttcctcagtgcactctctgactgaagcccggcgcgtggggtgcagcgggagtgcgaggggactggacaggtgggaagatgggaatgaggaccgggcggcgggaatgttctcacttctccggattccaccgggatgcaggactctagctgcccagccgcacctgcgaagagactacacttcccgaggtgctcagcggcagcgagggcctccacgcatgcgcaccgcggcgcgctgggcggggctggatgggctgtggtgggagggttgcagcgccgcgagaaaggcgagccgggccgggggcggggaaaggggtggggcaggaacgggggcggggacggcgctggaggggcgggtcgggtaggtctcccggagctgatgtgtactgtgtgcgccggggaggcgccggcttgtactcggcagcgcgggaataaagtttgctgatttggtgtctagcctggatgcctgggttgcaggccctgcttgtggtggcgctccacagtcatccggctgaagaagacctgttggactggatcttctcgggttttctttcagatattgttttgtatttacccatgaagacattgttttttggactctgcaaataggacatttcaaagatgagtgaaaaaaaattggaaacaactgcacagcagcggaaatgtcctgaatggatgaatgtgcagaataaaagatgtgctgtagaagaaagaaaggcatgtgttcggaagagtgtttttgaagatgacctccccttcttagaattcactggatccattgtgtatagttacgatgctagtgattgctctttcctgtcagaagatattagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaagctgaaatgcacagagacctggagccttaacagtctggttaaacacctcttaggtaaacagctcctgaaagacaagtctatccgctgtagcaattggagtaaatttcctctcactgaggaccagaaactgtatgcagccactgatgcttatgctggttttattatttaccgaaatttagagattttggatgatactgtgcaaaggtttgctataaataaagaggaagaaatcctacttagcgacatgaacaaacagttgacttcaatctctgaggaagtgatggatctggctaagcatcttcctcatgctttcagtaaattggaaaacccacggagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgagcatttatctcccaatgataatgaaaacgatacgtcctatgtaattgagagtgatgaagatttagaaatggagatgcttaagcatttatctcccaatgataatgaaaacgatacgtcctatgtaattgagagtgatgaagatttagaaatggagatgcttaagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataaggactttttgtggccagcacccaatgaagagcaagttacttgcctcaagatgtactttggccattccagttttaaaccagttcagtggaaagtgattcattcagtattagaagaaagaagagataatgttgctgtcatggcaactggatatggaaagagtttgtgcttccagtatccacctgtttatgtaggcaagattggccttgttatctctccccttatttctctgatggaagaccaagtgctacagcttaaaatgtccaacatcccagcttgcttccttggatcagcacagtcagaaaatgttctaacagatattaaattaggtaaataccggattgtatacgtaactccagaatactgttcaggtaacatgggcctgctccagcaacttgaggctgatattggtatcacgctcattgctgtggatgaggctcactgtatttctgagtgggggcatgattttagggattcattcaggaagttgggctccctaaagacagcactgccaatggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaagttcccactgggaatttgaaggtccaacaatcatctactgtccttctagaaaaatgacacaacaagttacaggtgaacttaggaaactgaatctatcctgtggaacataccatgcgggcatgagttttagcacaaggaaagacattcatcataggtttgtaagagatgaaattcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggcaccttcttactgagatacgtaatgagaagtttcgattatacaaattaaagatgatggcaaagatggaaaaatatcttcattctagcagatgtaggagacaaatcatcttgtctcattttgaggacaaacaagtacaaaaagcctccttgggaattatgggaactgaaaaatgctgtgataattgcaggtccagattggatcattgctattccatggatgactcagaggatacatcctgggactttggtccacaagcatttaagcttttgtctgctgtggacatcttaggcgaaaaatttggaattgggcttccaattttatttctccgaggatctaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaagggtagaaattggcttcataaagctaatacagaatctcagagcctcatccttcaagctaatgaagaattgtgtccaaagaagttgcttctgcctagttcgaaaactgtatcttcgggcaccaaagagcattgttataatcaagtaccagttgaattaagtacagagaagaagtctaacttggagaagttatattcttataaaccatgtgataagatttcttctgggagtaacatttctaaaaaaagtatcatggtacagtcaccagaaaaagcttacagttcctcacagcctgttatttcggcacaagagcaggagactcagattgtgttatatggcaaattggtagaagctaggcagaaacatgccaataaaatggatgttcccccagctattctggcaacaaacaagatactggtggatatggccaaaatgagaccaactacggttgaaaacgtaaaaaggattgatggtgtttctgaaggcaaagctgccatgttggcccctctgttggaagtcatcaaacatttctgccaaacaaatagtgttcagacagacctcttttcaagtacaaaacctcaagaagaacagaagacgagtctggtagcaaaaaataaaatatgcacactttcacagtctatggccatcacatactctttattccaagaaaagaagatgcctttgaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattaaaaaaaaaaaaaaaaaaaa

SEQ ID NO: 295 - DNA, 2620 bp, Homo sapiens
ctattggaggagaaggccgagaggagcaggacggcgggaagaggagtgcggaacccgcgggaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcaaaaaaaaaaaaaaaaaaa

SEQ ID NO: 296 - DNA, 3048 bp, Homo sapiens
gagccaatgaaagctcggaccagtggcaagtccgagctgtcattgagaggcgggacttccggcgccgccattgcggtcctcattttgctgctggtgggttgggctacagcaggcctctggagccacaccagggcacgggagtgggtgcagggaccgtcaccgcgccttcacacgcaccatagtgcccggctaattactctgcttttatgagccaaggtgttcccgaaagtggagccagcgccacgcgtctccagggtctccatacccagccttcgtccctgcggtgcccagaggccttgcgcgcattttgcatttgggaagacaggtcctgagtgcgaccgtcacccagcggaagtgtgagggttcggcccagcggcagggctagccctgggcctcctgttatggccctgcccagcccacaggttctaatggggttgccagcgttgctgatgggcccggcgcagcatacttcttggccctgtggctcagctgtccccacattgaagagcatggtaacctttgaagatgtggctgtatacttctcccaagaggagtgggagctccttgatgcagcccagaggcacctgtaccacagtgtgatgctggaaaaccttgagcttgtgacctcacttggttcttggcatggagtagagggtgagggggcccatcccaagcagaatgtttctgtagaagtgttacaggtcaggatccctaatgcagatccttccaccaagaaagctaactcctgtgacatgtgtgggccattcttgaaagacattttgcacctggctgagcatcagggaacacagtctgaggagaaaccctacacatgtggagcatgtgggagagacttttggttgaatgcaaaccttcaccagcaccagaaggagcacagtggagggaagccctttagatggtacaaggacagggacgcacttatgaagagctctaaagtccacctgtcagagaaccccttcacttgcagggaaggtgggaaggtcatcctgggcagctgtgacctcctccagcttcaagctgttgacagtgggcagaagccatattccaatcttgggcagcttccagaagtctgtaccacacagaaactcttcgagtgcagcaactgtggaaaagccttcctgaagagctccactctccccaaccatctgagaactcactctgaagagataccatttacatgcccaacaggtggaaatttcttagaggagaaatcaatccttggtaataaaaagtttcacactggggaaataccccatgtgtgtaaggagtgtgggaaggcctttagtcactcatctaagctgaggaagcaccagaaatttcacactgaagtaaaatattatgagtgcattgcatgtgggaaaaccttcaaccacaaactcacatttgttcatcatcagagaattcactcaggagaaagaccttatgagtgtgatgaatgtgggaaagccttcagtaacagatcacacctcattcggcatgagaaagttcacactggagaaaggccttttgagtgcctgaaatgtggaagagccttcagccaaagctccaatttccttcggcatcagaaagttcacacacaggtaagaccttatgagtgcagtcaatgtggtaaatccttcagccgaagctctgctctcattcagcactggagagttcacactggagaaagaccgtatgaatgcagtgaatgtggaagagcttttaacaataactccaaccttgctcagcaccagaaagttcacaccggagaacggccttttgagtgcagtgaatgtggaagagacttcagccaaagctcccatctccttcgacatcagaaagttcacactggagaacggccttttgaatgctgtgattgtggtaaagccttcagtaatagctccaccctcatccagcaccagaaagtacatactgggcaaaggccttatgagtgcagcgaatgtaggaaatccttcagccgcagctccagcctgattcagcactggagaattcacactggagaaaagccttacgagtgtagtgagtgtgggaaagcctttgctcacagctccactctcattgaacactggagagttcacacaaaagaaaggccttatgagtgcaatgaatgtgggaaattctttagccaaaactccattctcattaagcatcagaaagttcatactggagaaaagccttataaatgcagtgaatgtgggaaattctttagccgaaaatccagccttatttgtcactggagagttcacactggagaaaggccttacgaatgcagtgaatgtgggagagcctttagcagtaactcccacctggttcgtcatcagagagttcacacacaagaaaggccctatgagtgcatccagtgtggaaaagcctttagtgaaagatctacacttgttcggcaccagaaagttcacaccagagaaaggacttatgagtgtagccagtgtgggaaactcttcagccatctttgtaaccttgcacagcataaaaagattcatacctgagtggagccttatggaagtggtctttgtgagaaaatcttcagccaagtcaaacttcatgcagcagaatccccataccagaaaaattacctacatgtactgctaatgtggaaaagccttcagaagctactctgtttctgaccagcccaggaacctttgcagggccatctcacccatgcagcataaggcagaagccatagtcactttccatcttgcctggatccaaaaatttgcagcagtcctgtcctcatgcatggggaaaacagtaccctgagccttccttcctgtgttctctagggattcaggactgtgctcagctgaaccgatgctggttgaggggccttgagggaaatctaatttgagctcaggaagatgcacattccttgtggatgtggtcaagtctgtgtttaacccctaagatgtgtccattgaggccacaaatcaccctccactggaatcacctaccttgcctgcactaactggtgataataaagaccttattgatcaggtcaaaaaaaaaaaaaaaaaa

SEQ ID NO: 297 - DNA, 4325 bp, Homo sapiens
aggacggcttccgggatttggcggggcctttgtctctcgctgcagtcgcagctccaggtctcgtcttcactgctctatgtcctctgctcctagaggtccaccttctgtggccccgttacctgcaggtattgggagatccacagctaagacgccaggactccctggaagcctagaaatgggaccactgacatttagggatgtggccatagaattctctctggaggagtggcaatgcctggacacttcacagcagaatttgtataggaatgtgatgttagataactacagaaacctggtcttcctgggtattgctgtctctaagccagacctgatcacttgtctggagcaaggaaaagagccctgcaatatgaagagacatgcgatggtagccaaacccccagttgtgtgttctcattttgcccaagacctttggccaaagcagggcttaaaagattcttttcaaaaagtgatactgagaagatatggaaaatatggacatgagaatttacaattaagaaaaggctgtaaaagtgcggatgagcataaggtgcacaaaagaggttataatggacttaaccaatgtttgacaactacccagagcaaaatatttcaatgtgataaatatgttaaagtccttcataaattctcaaattcaaatatacataagaaaagacaaactggaaagaaacctttcaaatgtaaagaatgtggcaaatcatgttgcatactttcacaactaactcagcataagaaaactgctactagagtgaatttctacaaatgtaagacatgtggaaaagcctttaaccagttctcaaatcttactaaacataagataattcatcctgaagtgaatccctacaaatgtgaagaatgtggcaaagcctttaaccagtccttaactcttactaaacataaaaaaattcatactgaagagaaaccttacaaatgtgaagattgtggcaaagtctttagtgtattttcagtccttactaaacataagataattcatacaggaacaaaaccctacaattgtgaagaatgtggcaaaggctttagtatattctcaacccttactaaacataagataattcatactggagagaaaccctacaaatgcaatgaatgtggtaaagcctttaactggtcctcaactcttactaaacataagagaattcatactggagagaaaccctacaaatgtgaagaatgtggcaaagcttttaaccagtcctcaacccttactagacataagatagttcatactggagagaaaccctacaaatgtgaagaatgtggtaaagcctttaaacggtccacaactcttactaaacataagagaatttatactaaagagaaaccatacaaatgtgaagaatgtggaaaagcctttagtgtattctcaacccttactaaacataagataattcatactggagcaaaaccttacaaatgtgaagaatgtggcagtgcctttagggcattctcaacccttactgaacataagagagttcatactggagagaaaccttacaaatgcaatgaatgtggtaaagcctttaactggtcctcaactcttactaaacataagagaattcatactggagagaagccctacaaatgtgaagaatgtggcaaagcttttaaccggtcctcaaaccttactcgacataagaaaattcatactggagagaaaccatacaaacctaaaagatgtgacagtgcttttgacaacaccccaaacttttctagacataaaagaaatcatatgggtgagaaatcctagaaatgtgaagaatgtgacaaagcctttaagcggttgtcacacttgattgtatataagataattcatactggagaaaactcccagaagtggagttttccttattgcacaggaaagcatttatacttgagaaaaattgtataaagaatggaaaagtcattaatatctgctcatatcttaacatcagcgagttggtatttaataaaagcattatcaatgaaattactgtcaaaagatctttcagacaatataagcctgcaaagtgcagcagagtatttattttgaagagaaacattaaaagtacaaagaggtttgtagtacctttgtttgtatcatagatcttattgtacacattttgtaccagagaaaaaccctgaagcagttgttcaaactttgttcaataccaggaaatttatattggagaaaaaccctatgagtgtaatgaatttggaaaaatatttttttcaacaacagcttagaaaacatgggaggaattacactaaaatatatttttgcaaatgcagcagtaaatatgaaagaaatgatccaaagttaggtttatataaatatcagagaattcacaatacagatatctaagatactgacacttcagacattacacaaaatcagagtgctgagtacagaaagttatccaaaacaaaagttggtagataactaatagtgaacaagtttttggcagaggtatatttacattcagagtacacttttctttggaaaaaattacaggttttttgaaaagtgaataatgtaattcaactctcaaattcatggtttttttttttttggttttggttttgggttttttgtttgtttgtttgtttgtttttgagacggagtttcactcttgttgcccaggctggagtgcaatggcgtgatctcagctcaccgcaacctctgcctcccagattcaagcaattctcctgcctcagcctccctagtagctgggattacaggcatgtgccacacctggctaatttttgtggttttagtagagacagggtttctccatgttggtcagtctggtctcaaactcccaacctcaggtgatatgcccgcctcggcctcccaaaatgttgggattacaggcatgagccactgcacccggcgcatgttttttcttcattcctattgtattcacatgtgaaagcatgtgatcaacttgctgcatcaaagatatgagatttttttttttattaggtgggcattatttatgaccttttctgtggaagagtaagaacattaaaatgaaagatgcatgatgaaaatctaagtagagaggctcttgtggttaactgataatattgagtgatgcatgaggtaggtgttcagagtaatattctgcattatagtgaaaaatttttaatattaaaattcaattatatcattttatgaattgtgcttttcataatgcagtacatttcaaaatttttagattatgtatgaacttagatttttaaacatgttttaacatgttaagacttgtgcattcagtgaagcgttattatgccacaaactaacctacctcaccttactcaatggtgtaggtaaaagatgatagcaatatattatttggttacatagtggactaacatttttagtaatctcttttgccagtggctttaaactgcagataagttaaatattcccataggttttacatttatattttttcttatttaaatttattgttcttatttttcatgggtacatagtatgtttttatgctgtatatggcatgttttgatacaggtatataatatgtaataatcacatcagggtaaatgaggtatcccttactagcatttatcctttgtattttattttaaaatgtacaactaaattgttatggactacagggttatttttatggtcataataaaaattacaaaagtatgaataaaatacatacatttctgagtcctgaatatttttaaaaatttgttatatatttttcttctaacatgtggcctctttgcctgcaaacatataaagactcagttttgatttacatagagttaaatatacatatattttactttaaagataaatcttaagtgtaagaaaattgtagagtaagtgtgcttgtgtgagtatgtttgtacctgttttcaaaagaaaacagcaatattggaacaaaacaaatcattttaataaggtgactaatttattagaaaactaacaacctcaaaaatgctgaaagcaaatctatactctctctgctttgtactgaattcattactgtaaaatattatggcttatggttcagaatctccccatgcagatgttctgtttttacttgcctggtactcatggtagagccatacatttcttttttcttacaatttcttttacagtttatgaagtattatatgagctggtcagggattacaacaattattttttttataaaatttagtagtgcacaaaaagtaatttttagatgtaattttactattagtctattaagttatattttatttatttagttaaaacattgccctttgttcttttaattggagaa

SEQ ID NO: 298 - DNA, 4399 bp, Homo sapiens
gcattctggttgtgaaggctgagttctagagatcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacgaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggcatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgagtagtatttcagtatttcattgtataccacaatttttcttctttgtcaacttaattgttatggatgtttgggtaactttcagtttttggctattacaaataaacctctgaagatttgtgtgcaaa

SEQ ID NO: 299 - DNA, 4317 bp, Homo sapiens
tgaaggctgagttctagagatcgggtcggctttctacgcggctctcgtggaacctagcaaagaaagacagtgaagactgcaggaccttccttcgcgcttttgttacagcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacgaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggcatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgagtagtatttcagtatttcattgtataccacaatttttcttctttgtcaacttaattgttatggatgtttgggtaactttcagtttttggctattacaaataaacctctgaagatttgtgtgcaaa

SEQ ID NO: 300 - DNA, 2910 bp, Homo sapiens
gttgtcctcggaaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaataggtcctggttccacaaggataaaacacatctgcagtgcaaatagaagtctgaggaacaggtgtcttatcatggaaggagacctgacctgagacctgccttagaggctggagagtcctgaaagagagtggaccctggagttgctggagcttgtcttgacccttctgcccagagcaggcagggtctgaatgacatctcaatcttcagtgatcagcaatagctgtgtgacaatggagcgtttgagccacatgatggaaaggaaagcttggtgttctcaagagtctgccctttccgaggaagaagaggatacaaccaggcctcttgaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaagtttgggaagttgatgaacagatcaagaagcaacaggaaacacttgtgaggaaagtcacatccatctccaagaaaattctgataaaggaaaaagtcattgaatgtaaaaaagttgcgaaaatatttcctctgagttcagacattgttacttcaagacaaagcttctatgactgtgactcacttgataagggtttggaacataatttagacttacttagatatgagaaaggctgtgtaagagagaaacagagtaatgagtttgggaaaccattttaccattgtgcatcctatgttgtaaccccctttaagtgtaatcagtgtggacaagacttcagtcataaatttgacctcattagacatgagcgaattcatgctggagagaaaccttacgaatgtaaagaatgtggaaaagccttcagtaggaaggaaaatcttattacacatcagaaaattcatactggggaaaaaccgtataagtgtaatgaatgtggaaaagctttcattcagatgtcaaaccttattagacaccacagaattcatactggggagaaaccttatgcatgtaaggattgttggaaagccttcagtcagaaatcaaatctcattgaacatgagcgaattcacactggagagaaaccctatgaatgtaaggaatgtgggaaatccttcagccagaagcaaaatcttattgagcacgagaaaattcatactggggagaaaccttatgcatgtaatgaatgtggtagagctttttctcgaatgtcatctgttacgctacatatgagaagtcacacaggggagaaaccctataaatgtaataaatgtggaaaagctttctctcaatgctcagtatttattatacatatgagaagtcacactggtgagaaaccctatgtatgtagtgaatgtgggaaagccttctctcagagttcatccctaaccgtacatatgcgaaatcatacagctgagaaaccctatgaatgtaaggaatgtggaaaagccttcagcaggaaagaaaatctcattacacatcagaaaattcacactggagagaaaccttatgaatgcagtgaatgtgggaaagcttttattcagatgtcaaacctcattcgacaccagagaattcatacgggtgagaaaccctatgcatgtacagtatgtggaaaagcctttagtcagaaatcaaacctcactgaacatgagaaaattcatactggagagaaaccttatcattgtaatcaatgtgggaaagctttcagtcagagacaaaatcttcttgagcatgaaaaaattcatactggagagaaaccattcaaatgtaatgaatgtggtaaagccttctctcgaatctcatccctcactcttcatgtgagaagtcacacaggggagaaaccctatgaatgtaataaatgtgggaaagccttttctcagtgctcattacttattatacatatgagaagtcatactggtgagaaaccctttgaatgtaatgaatgtgggaaagcattctctcaaagagcatccctttctatacataagagaggtcatacaggtgagagacaccaagtatattaaatgaaagaaggcctcttaaattcaacccatgttttacttaaaatatcttggcataagctcaaaaaagccaggatctttatggaaaaattttaatactttgttaaaaggtgtaagactggaataaatggaaagaaataccatatacatagatggaaaaacccagtattataaaaacctcaattctgaaaatctatagactgaatgcagttccaaacaaaatcaactaagaattttctaggatctttcaaaaatgattataaaattcatgtgaaatagaagtgtatgaattgctgcgacaattttgaaaagaatagaggaaacaccctcactgtatgatataaagttatagtcatttaaaaatgtgtgatattagtacattagtaggtaaatgagcagattttaaagaatagaatatccagaagcagattcatgaatatatgtgaactcagtgtatgttaga

SEQ ID NO: 301 - DNA, 705 bp, Homo sapiens
atgcctctgaacgtggctcttcagaagcaagcctctctaaaggaggcctttgaagaaaaggcgagtgatcagaataaagagagggagcgggggtggggagggggcgggagcaccgagtggctgtctgactcctccggtcagaggtaccagaataggctaaatatccccagcggctgccatcccagcgggtgggatgagagcgagcctgagctctgctcccttgatctcctctgcgtctctgctggatggcagggccagccccgggacaaaatccaaatgttggtcaaagtcctttttctcccagacatgttcacacgtgggtgcaagctgatctccattgtcagtacacagatgcccatgaataatgccgtggatatacacatgtgtgttgcacaagctacacaagctaaagctggtaacccaaccctgaagaccctcacgagctgctgtgggggatcttggcaaccacccttccttgccagccaggtcctcactgctggagcagtggatatatttatggatctgaagctttgccatgaagaggcaccatgcacctcctcattcccatctctcaacatttccatggcctctggagatagtcctctcttgttcttgttctatgtaaaagacctggagtctgacccctttgtccccatggaggtaacaggatactggaagagacttttcctggtaccccagaattga

SEQ ID NO: 302 - DNA, 467 bp, Homo sapiens
gatgttaggtctctgagatcatagtaatgcagtcagcaatgaaacctacctggttaattagagaaacacagctccatcgatgtaagacagaagtctgggctgccgagtgtctgacgggacaaatccttccaacggccgcagcaggtgcttcttctagccctgtgttgcaatgacctgcagctcctggggataactcaggcacgctgctgacgccatcaggaggctcaacaccctcacccgcttacgctacgaccagcaaaagcaaaccccgcagctgcctgccagccgggaagaaggactgtgtttccatgttgtgagtctcctcattgcagccagatgatgaatttgctgctggctttgtgcgaaaccgagaaatacccagcgtccagctgagggcccgggtggcaacaaaatcaagctgatgaattaaagaaatatggcctggtcaggatgcctggaggcctcag

SEQ ID NO: 303 - DNA, 338 bp, Homo sapiens
aaaattagagactaacagtaaatttactttaatttttacgaataattctctatcaatgtaaaaatttttcatatacgcgtgtatgaaagaaaaacactactatttttccacattcgtgaaaactgcttaactgggacagtaaccgagcggccagtgaatatttaaaatactgtaaccgacgaatacgtatgcttctaggaccacgtggaatctttcccatggtaggtaagcaaaacaaatgtgcttcccagaaccctccaaactgctcgtgggtatattactacagattacataatgcagcagcgttccgggacgcaagcccagaaaaagataattaa

SEQ ID NO: 304 - DNA, 736 bp, Homo sapiens
ctagtatcgcgagatcaggaaggtggccgagtgtgtcgccgcggccatcaggcacttctccttcctgcccttgtatgaagaaggatgtgtttgcttccccttgtgccatgattgtaaatttcctgaggcctcctcagccctgcagaactggggttatagccatgtgactgatcttcgtccaagaatatgtaaagaaaaagtgttgagttggcttttagggctagagcaatgtatcttaggctcacttaaggaagctgtagagatgagcccaaggagggaaaccagaagagccccccaggctcaccagttgtttgttggctccctacaaacatgtcattcaagtggctaatcttacaacagcacaaattcatctaaccagaaagagaagaggaggctccaaaggcacttgactactgagcatcaccctggacgtgtacaagtctgcgtccttattgttttcttcattgggccgaactttctggtcctcatccaacagctcttctatcacgtgttcgaaagtgtcagccaatgatgtcaagcctcttgaacctgccttgggcccattcacgctctccagagtcccatgggtccgcacacctggagatactctattatagcaaagaagaaagataatttcattgagccatcctgttttacagtattgaattattaccacaaggtaccaaccatatatgcatacttaatagggtattttgtcaaaactatgcatgaaggt

SEQ ID NO: 305 - DNA, 2365 bp, Homo sapiens
aattggtcaccccaatgcaggggatacagacttgttttaatataaaaaagaagtggccttaaccgtgcagggcttgcaggcctttgtaggcatgggagcatgctgtgatccctggttctgtgctaaacactcaaaagggctctctgactcaagtggaggtgataaaccttttcaatagtaacaggagagagtgtgatatcaaagtgccagaagtcctcacagaccaacatttagcacagacattcaaactgctgaaagaaccaaacagaactcaactgaaaaaaacagaccttttaagaaaagcaatagatcttaatttggtggcaagatccctggtttaccttttgaagtcaaaatgttcaatacatcacccgagcttgacttttgagcacttggcaagattgttttttgccacttgacacaagtatgatgtccagctatgcaaaatgactgtttgatctgccttttcagtgtatttgtgtggcgatgtctgtaaaatgccagaagcctcttatgttattgctgctgctgctaccagccagcaactgcagaggccatgctgaggtgcctccttgccaccagccgttgggaaatgcctaccatgctgccccggatgcacaagctcaaaacgctgcagaagttacacaactgctcccataatctggactctccaaaaccgtgatgccacgaaggaaggtcaagttttaaaatgttaaagactgcttgcctctgttcctgagactaaacagtatacatactaactacattgacaaagaaatcctatctgataatgtagcccgctgacgaattttgaagcctcggttaccctaaccaatatgtagcttttaatttgcatcaaaacttttacaaagatgttttgctattgtttctatatacttcaagaatgttcatttttacaaataagttgaacaagacagcctaagttagatgcaccgaagtactagaaatatcgctagcctctgttctccagtttagctttcaaaaccaaatgagccatgtataaaggagttgagaaacttaatttttaaatgtttcatttgcagagttttatatccattaagtgcctttgaaagtttccagttgtgtgggctgctgtctcacctcccaccaatttctcctttctccttatggtgctaaaacctcaaagctgaggagggctgcaggacccttagcagattcagtgtgtcacccttgtcctgtgttcacgccaaggcttcctaaatgaaagacatcggttacctgcttatgggaaggtgagcagcaaaggaattgaagttcgggacagggtagaattatgggttttcattgtgtttcatgccaaacccacaaaatccaaaatagaattcaagttaaacaaacttctactacaaaatggaaggggaaaaaggctcaggaaggtctatgagaatgagctgacttatctcgttaaatcttaagataaatgagggtaacccaaggctgcaccttggtgtaccaccctgagtggagttgaggtgacttcatttgattgcttcaggcgaactatataggtcaagtccagattataaaaaaattatctgcagaacaaattgtaaacccaaggaatagctggtaaatcaaaattataaagtgagttagagttccttggagttggttgtatgacggaatatgacttggacaatctttaccagaagccatccgtaagcccctcagtcacactttccatgtagctgaccagtgactacaggatgtggctgacagtgctcactgaaaggagagttggtgcgggactggtggttctgagcacatagacgcctattagtccttctggtcagtgaacgaaaattctagacctacagttactggctacttgcatttgtcagtttagagaaaaggtaaaatgaggcattttcaattgtagaatagactaacatttaccacagaagtgcttcagcattctaaatggattagatcactcattaagctatttttatatgccaatttactaatgccttacatcaatccactaataggttgttgggcccgcagtagagtccctatgcagtctgcctatcttgtactagactcttcatgctgatcggatcttgcattgaaataaccatgtggaagaacaatgaatcgattaatgatgacatgtacaaccatatttaaagagcaatagtgtccgtgtgtcatgaaaaacttatttgtaaacgtttatatggtatgattttgattttatgtatgttcataaatcctgcactgtatgatatatgtgagttaaaacattggtgcatgaatttattttcaaagtataaaacacatcacttaaacattttatgtgtcaaataaaatttgattatgt

SEQ ID NO: 306 - DNA, 503 bp, Homo sapiens
catttgcagagttttatatccattaagtgcctttgaaagtttccagttgtgtgggctgctgtctcacctcccaccaatttctcctttctccttatggtgctaaaacctcaaagctgaggagggctgcaggacccttagcagattcagtgtgtcacccttgtcctgtgttcacgccaaggcttcctaaatgaaagacatcggttacctgcttatgggaagactcttcatgctgatcggatcttgcattgaaataaccatgtggaagaacaatgaatcgattaatgatgacatgtacaaccatatttaaagagcaatagtgtccgtgtgtcatgaaaaacttatttgtaaacgtttatatggtatgattttgattttatgtatgttcataaatcctgcactgtatgatatatgtgagttaaaacattggtgcatgaatttattttcaaagtataaaacacatcacttaaacattttatgtgtcaaataaaatttgattatgtaaa

SEQ ID NO: 307 - DNA, 369 bp, Homo sapiens
atgtgggcacttcccttccatcgtggtgaggccaaagcaaaggcacagagacctgaacacaaacatgaaaaacaccttaccacctgggagtcaggggcaggttcaggcacatccattcctctggcatttgagcagctgttttccacagcattaactcagcacggcaggaaaagccacaaaagcgtggccccaggtaaatcctatgtctgggaggtaacccgatcaccgcggaaagaacgccgacatggaaatcttaggattggtttctcgttccaggaagttgcgctactttgggcaaatcacgtcacctctgggactgtttctaatcagaataaagaaagggctggaccaatctttcagatcctttga

SEQ ID NO: 308 - protein, 2261 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDIFLRVMSRSMPLFMTLAWIYSVAVIIKGIVYEKEARLKETMRIMGLDNSILWFSWFISSLIPLLVSAGLLVVILKLGNLLPYSDPSVVFVFLSVFAVVTILQCFLISTLFSRANLAAACGGIIYFTLYLPYVLCVAWQDYVGFTLKIFASLLSPVAFGFGCEYFALFEEQGIGVQWDNLFESPVEEDGFNLTTSVSMMLFDTFLYGVMTWYIEAVFPGQYGIPRPWYFPCTKSYWFGEESDEKSHPGSNQKRISEICMEEEPTHLKLGVSIQNLVKVYRDGMKVAVDGLALNFYEGQITSFLGHNGAGKTTTMSILTGLFPPTSGTAYILGKDIRSEMSTIRQNLGVCPQHNVLFDMLTVEEHIWFYARLKGLSEKHVKAEMEQMALDVGLPSSKLKSKTSQLSGGMQRKLSVALAFVGGSKVVILDEPTAGVDPYSRRGIWELLLKYRQGRTIILSTHHMDEADVLGDRIAIISHGKLCCVGSSLFLKNQLGTGYYLTLVKKDVESSLSSCRNSSSTVSYLKKEDSVSQSSSDAGLGSDHESDTLTIDVSAISNLIRKHVSEARLVEDIGHELTYVLPYEAAKEGAFVELFHEIDDRLSDLGISSYGISETTLEEIFLKVAEESGVDAETSDGTLPARRNRRAFGDKQSCLRPFTEDDAADPNDSDIDPESRETDLLSGMDGKGSYQVKGWKLTQQQFVALLWKRLLIARRSRKGFFAQIVLPAVFVCIALVFSLIVPPFGKYPSLELQPWMYNEQYTFVSNDAPEDTGTLELLNALTKDPGFGTRCMEGNPIPDTPCQAGEEEWTTAPVPQTIMDLFQNGNWTMQNPSPACQCSSDKIKKMLPVCPPGAGGLPPPQRKQNTADILQDLTGRNISDYLVKTYVQIIAKSLKNKIWVNEFRYGGFSLGVSNTQALPPSQEVNDAIKQMKKHLKLAKDSSADRFLNSLGRFMTGLDTKNNVKVWFNNKGWHAISSFLNVINNAILRANLQKGENPSHYGITAFNHPLNLTKQQLSEVALMTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDMVKNQAMADALERFGENRFVSPLSWDLVGRNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVLKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 309 - protein, 1545 aa, Homo sapiens
MLEKFCNSTFWNSSFLDSPEADLPLCFEQTVLVWIPLGFLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLEDVEKKKKKSGTKKDVPKSWLMKALFKTFYMVLLKSFLLKLVNDIFTFVSPQLLKLLISFASDRDTYLWIGYLCAILLFTAALIQSFCLQCYFQLCFKLGVKVRTAIMASVYKKALTLSNLARKEYTVGETVNLMSVDAQKLMDVTNFMHMLWSSVLQIVLSIFFLWRELGPSVLAGVGVMVLVIPINAILSTKSKTIQVKNMKNKDKRLKIMNEILSGIKILKYFAWEPSFRDQVQNLRKKELKNLLAFSQLQCVVIFVFQLTPVLVSVVTFSVYVLVDSNNILDAQKAFTSITLFNILRFPLSMLPMMISSMLQASVSTERLEKYLGGDDLDTSAIRHDCNFDKAMQFSEASFTWEHDSEATVRDVNLDIMAGQLVAVIGPVGSGKSSLISAMLGEMENVHGHITIKGTTAYVPQQSWIQNGTIKDNILFGTEFNEKRYQQVLEACALLPDLEMLPGGDLAEIGEKGINLSGGQKQRISLARATYQNLDIYLLDDPLSAVDAHVGKHIFNKVLGPNGLLKGKTRLLVTHSMHFLPQVDEIVVLGNGTIVEKGSYSALLAKKGEFAKNLKTFLRHTGPEEEATVHDGSEEEDDDYGLISSVEEIPEDAASITMRRENSFRRTLSRSSRSNGRHLKSLRNSLKTRNVNSLKEDEELVKGQKLIKKEFIETGKVKFSIYLEYLQAIGLFSIFFIILAFVMNSVAFIGSNLWLSAWTSDSKIFNSTDYPASQRDMRVGVYGALGLAQGIFVFIAHFWSAFGFVHASNILHKQLLNNILRAPMRFFDTTPTGRIVNRFAGDISTVDDTLPQSLRSWITCFLGIISTLVMICMATPVFTIIVIPLGIIYVSVQMFYVSTSRQLRRLDSVTRSPIYSHFSETVSGLPVIRAFEHQQRFLKHNEVRIDTNQKCVFSWITSNRWLAIRLELVGNLTVFFSALMMVIYRDTLSGDTVGFVLSNALNITQTLNWLVRMTSEIETNIVAVERITEYTKVENEAPWVTDKRPPPDWPSKGKIQFNNYQVRYRPELDLVLRGITCDIGSMEKIGVVGRTGAGKSSLTNCLFRILEAAGGQIIIDGVDIASIGLHDLREKLTIIPQDPILFSGSLRMNLDPFNNYSDEEIWKALELAHLKSFVASLQLGLSHEVTEAGGNLSIGQRQLLCLGRALLRKSKILVLDEATAAVDLETDNLIQTTIQNEFAHCTVITIAHRLHTIMDSDKVMVLDNGKIIECGSPEELLQIPGPFYFMAKEAGIENVNSTKF

SEQ ID NO: 310 - protein, 1325 aa, Homo sapiens
MLPVYQEVKPNPLQDANICSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFKEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 311 - protein, 397 aa, Homo sapiens
MNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVATKWQVSREDQDKVAVLSQNRTENAQKAGHFDKEIVPVLVSTRKGLIEVKTDEFPRHGSNIEAMSKLKPYFLTDGTGTVTPANASGINDGAAAVALMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 312 - protein, 423 aa, Homo sapiens
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 313 - protein, 586 aa, Homo sapiens
MLARVTRKMLRHAKCFQRLAIFGSVRALHKDNRTATPQNFSNYESMKQDFKLGIPEYFNFAKDVLDQWTDKEKAGKKPSNPAFWWINRNGEEMRWSFEELGSLSRKFANILSEACSLQRGDRVILILPRVPEWWLANVACLRTGTVLIPGTTQLTQKDILYRLQSSKANCIITNDVLAPAVDAVASKCENLHSKLIVSENSREGWGNLKELMKHASDSHTCVKTKHNEIMAIFFTSGTSGYPKMTAHTHSSFGLGLSVNGRFWLDLTPSDVMWNTSDTGWAKSAWSSVFSPWIQGACVFTHHLPRFEPTSILQTLSKYPITVFCSAPTVYRMLVQNDITSYKFKSLKHCVSAGEPITPDVTEKWRNKTGLDIYEGYGQTETVLICGNFKGMKIKPGSMGKPSPAFDVKIVDVNGNVLPPGQEGDIGIQVLPNRPFGLFTHYVDNPSKTASTLRGNFYITGDRGYMDKDGYFWFVARADDVILSSGYRIGPFEVENALNEHPSVAESAVVSSPDPIRGEVVKAFVVLNPDYKSHDQEQLIKEIQEHVKKTTAPYKYPRKVEFIQELPKTISGKTKRNELRKKEWKTI

SEQ ID NO: 314 - protein, 438 aa, Homo sapiens
MLARVTRKMLRHAKCFQRLAIFGSVRALHKDNRTATPQNFSNYESMKQDFKLGIPEYFNFAKDVLDQWTDKEKAGKKPSNPAFWWINRNGEEMRWSFEELGSLSRKFANILSEACSLQRGDRVILILPRVPEWWLANVACLRTGTVLIPGTTQLTQKDILYRLQSSKANCIITNDVLAPAVDAVASKCENLHSKLIVSENSREGWGNLKELMKHASDSHTCVKTKHNEIMAIFFTSGTSGYPKMTAHTHSSFGLGLSVNGRFWLDLTPSDVMWNTSDTGWAKSAWSSVFSPWIQGACVFTHHLPRFEPTSILQTLSKYPITVFCSAPTVYRMLVQNDITSYKFKSLKHCVSAGEPITPDVTEKWRNKTGLDIYEGYGQTETVLICGNFKGMKIKPGSMGKPSPAFDVKVCTSPSRRMFNNPICTLPTYRLPPYKLSLL

SEQ ID NO: 315 - protein, 967 aa, Homo sapiens
MQRAVPEGFGRRKLGSDMGNAERAPGSRSFGPVPTLLLLAAALLAVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLATAAPGEKPPAPLQFHLLRRNRQGDVGGTCGVVDDEPRPTGKAETEDEDEGTEGEDEGAQWSPQDPALQGVGQPTGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 316 - protein, 737 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEDLVPEPTTGDDSDAATFKPTLPDLSPDEPSEALGFPMLEKEEEAHRPPSPTEAPTEASPEPAPDPAPVAEEAAPSAVEEGAAADPGSDGSPGKSPSKKKKKFRTPSFLKKSKKKSDS

SEQ ID NO: 317 - protein, 768 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEDLVPEPTTGDDSDAATFKPTLPDLSPDEPSEALGFPMLEKEEEAHRPPSPTEAPTEASPEPAPDPAPVAEEAAPSAVEEGAAADPGSDGSPGKSPSKKKKKFRTPSFLKKSKKKSDS

SEQ ID NO: 318 - protein, 631 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEGDGCAREYLLP

SEQ ID NO: 319 - protein, 662 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEGDGCAREYLLP

SEQ ID NO: 320 - protein, 359 aa, Homo sapiens [sequence omitted]

SEQ ID NO: 321 - protein, 359 aa, Homo sapiens [sequence omitted]

SEQ ID NO: 322 - protein, 359 aa, Homo sapiens [sequence omitted]

SEQ ID NO: 323 - protein, 359 aa, Homo sapiens [sequence omitted]

SEQ ID NO: 324 - protein, 359 aa, Homo sapiens [sequence omitted]

SEQ ID NO: 325 - protein, 848 aa, Homo sapiens
MNSSSANITYASRKRRKPVQKTVKPIPAEGIKSNPSKRHRDRLNTELDRLASLLPFPQDVINKLDKLSVLRLSVSYLRAKSFFDVALKSSPTERNGGQDNCRAANFREGLNLQEGEFLLQALNGFVLVVTTDALVFYASSTIQDYLGFQQSDVIHQSVYELIHTEDRAEFQRQLHWALNPSQCTESGQGIEEATGLPQTVVCYNPDQIPPENSPLMERCFICRLRCLLDNSSGFLAMNFQGKLKYLHGQKKKGKDGSILPPQLALFAIATPLQPPSILEIRTKNFIFRTKHKLDFTPIGCDAKGRIVLGYTEAELCTRGSGYQFIHAADMLYCAESHIRMIKTGESGMIVFRLLTKNNRWTWVQSNARLLYKNGRPDYIIVTQRPLTDEEGTEHLRKRNTKLPFMFTTGEAVLYEATNPFPAIMDPLPLRTKNGTSGKDSATTSTLSKDSLNPSSLLAAMMQQDESIYLYPASSTSSTAPFENNFFNESMNECRNWQDNTAPMGNDTILKHEQIDQPQDVNSFAGGHPGLFQDSKNSDLYSIMKNLGIDFEDIRHMQNEKFFRNDFSGEVDFRDIDLTDEILTYVQDSLSKSPFIPSDYQQQQSLALNSSCMVQEHLHLEQQQQHHQKQVVVEPQQQLCQKMKHMQVNGMFENWNSNQFVPFNCPQQDPQQYNVFTDLHGISQEFPYKSEMDSMPYTQNFISCNQPVLPQHSKCTELDYPMGSFEPSPYPTTSSLEDFVTCLQLPENQKHGLNPQSAIITPQTCYAGAVSMYQCQPEPQHTHVGQMQYNPVLPGQQAFLNKFQNGVLNETYPAELNNINNTQTTTHLQPLHHPSEARPFPDLTSSGFL

SEQ ID NO: 326 - protein, 512 aa, Homo sapiens
MATANGAVENGQPDGKPPALPRPIRNLEVKFTKIFINNEWHESKSGKKFATCNPSTREQICEVEEGDKPDVDKAVEAAQVAFQRGSPWRRLDALSRGRLLHQLADLVERDRATLAALETMDTGKPFLHAFFIDLEGCIRTLRYFAGWADKIQGKTIPTDDNVVCFTRHEPIGVCGAITPWNFPLLMLVWKLAPALCCGNTMVLKPAEQTPLTALYLGSLIKEAGFPPGVVNIVPGFGPTVGAAISSHPQINKIAFTGSTEVGKLVKEAASRSNLKRVTLELGGKNPCIVCADADLDLAVECAHQGVFFNQGQCCTAASRVFVEEQVYSEFVRRSVEYAKKRPVGDPFDVKTEQGPQIDQKQFDKILELIESGKKEGAKLECGGSAMEDKGLFIKPTVFSEVTDNMRIAKEEIFGPVQPILKFKSIEEVIKRANSTDYGLTAAVFTKNLDKALKLASALESGTVWINCYNALYAQAPFGGFKMSGNGRELGEYALAEYTEVKTVTIKLGDKNP

SEQ ID NO: 327 - protein, 1620 aa, Homo sapiens
MGAIGLLWLLPLLLSTAAVGSGMGTGQRAGSPAAGPPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 328 - protein, 663 aa, Homo sapiens
MGRYRIRVATGAWLFSGSYNRVQLWLVGTRGEAELELQLRPARGEEEEFDHDVAEDLGLLQFVRLRKHHWLVDDAWFCDRITVQGPGACAEVAFPCYRWVQGEDILSLPEGTARLPGDNALDMFQKHREKELKDRQQIYCWATWKEGLPLTIAADRKDDLPPNMRFHEEKRLDFEWTLKAGALEMALKRVYTLLSSWNCLEDFDQIFWGQKSALAEKVRQCWQDDELFSYQFLNGANPMLLRRSTSLPSRLVLPSGMEELRAQLEKELQNGSLFEADFILLDGIPANVIRGEKQYLAAPLVMLKMEPNGKLQPMVIQIQPPNPSSPTPTLFLPSDPPLAWLLAKSWVRNSDFQLHEIQYHLLNTHLVAEVIAVATMRCLPGLHPIFKFLIPHIRYTMEINTRARTQLISDGGIFDKAVSTGGGGHVQLLRRAAAQLTYCSLCPPDDLADRGLLGLPGALYAHDALRLWEIIARYVEGIVHLFYQRDDIVKGDPELQAWCREITEVGLCQAQDRGFPVSFQSQSQLCHFLTMCVFTCTAQHAAINQGQLDWYAWVPNAPCTMRMPPPTTKEDVTMATVMGSLPDVRQACLQMAISWHLSRRQPDMVPLGHHKEKYFSGPKPKAVLNQFRTDLEKLEKEITARNEQLDWPYEYLKPSCIENSVTI

SEQ ID NO: 329 - protein, 967 aa, Homo sapiens
MAKGFYISKSLGILGILLGVAAVCTIIALSVVYSQEKNKNANSSPVASTTPSASATTNPASATTLDQSKAWNRYRLPNTLKPDSYQVTLRPYLTPNDRGLYVFKGSSTVRFTCKEATDVIIIHSKKLNYTLSQGHRVVLRGVGGSQPPDIDKTELVEPTEYLVVHLKGSLVKDSQYEMDSEFEGELADDLAGFYRSEYMEGNVRKVVATTQMQAADARKSFPCFDEPAMKAEFNITLIHPKDLTALSNMLPKGPSTPLPEDPNWNVTEFHTTPKMSTYLLAFIVSEFDYVEKQASNGVLIRIWARPSAIAAGHGDYALNVTGPILNFFAGHYDTPYPLPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKNYLKKQVTPLFIHFRNNTNNWREIPENLMDQYSEVNAISTACSNGVPECEEMVSGLFKQWMENPNNNPIHPNLRSTVYCNAIAQGGEEEWDFAWEQFRNATLVNEADKLRAALACSKELWILNRYLSYTLNPDLIRKQDATSTIISITNNVIGQGLVWDFVQSNWKKLFNDYGGGSFSFSNLIQAVTRRFSTEYELQQLEQFKKDNEETGFGSGTRALEQALEKTKANIKWVKENKEVVLQWFTENSK

SEQ ID NO: 330 - protein, 396 aa, Homo sapiens
MFLKAVVLTLALVAVAGARAEVSADQVATVMWDYFSQLSNNAKEAVEHLQKSELTQQLNALFQDKLGEVNTYAGDLQKKLVPFATELHERLAKDSEKLKEEIGKELEELRARLLPHANEVSQKIGDNLRELQQRLEPYADQLRTQVSTQAEQLRRQLTPYAQRMERVLRENADSLQASLRPHADELKAKIDQNVEELKGRLTPYADEFKVKIDQTVEELRRSLAPYAQDTQEKLNHQLEGLTFQMKKNAEELKARISASAEELRQRLAPLAEDVRGNLRGNTEGLQKSLAELGGHLDQQVEEFRRRVEPYGENFNKALVQQMEQLRQKLGPHAGDVEGHLSFLEKDLRDKVNSFFSTFKEKESQDKTLSLPELEQQQEQQQEQQQEQVQMLAPLES

SEQ ID NO: 331 - protein, 4563 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVATTTKAQIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQSSPDKKLTIFKTELRVRESDEETQIKVNWEEEAASGLLTSLKDNVPKATGVLYDYVNKYHWEHTGLTLREVSSKLRRNLQNNAEWVYQGAIRQIDDIDVRFQKAASGTTGTYQEWKDKAQNLYQELLTQEGQASFQGLKDNVFDGLVRVTQEFHMKVKHLIDSLIDFLNFPRFQFPGKPGIYTREELCTMFIREVGTVLSQVYSKVHNGSEILFSYFQDLVITLPFELRKHKLIDVISMYRELLKDLSKEAQEVFKAIQSLKTTEVLRNLQDLLQFIFQLIEDNIKQLKEMKFTYLINYIQDEINTIFSDYIPYVFKLLKENLCLNLHKFNEFIQNELQEASQELQQIHQYIMALREEYFDPSIVGWTVKYYELEEKIVSLIKNLLVALKDFHSEYIVSASNFTSQLSSQVEQFLHRNIQEYLSILTDPDGKGKEKIAELSATAQEIIKSQAIATKKIISDYHQQFRYKLQDFSDQLSDYYEKFIAESKRLIDLSIQNYHTFLIYITELLKKLQSTTVMNPYMKLAPGELTIIL

SEQ ID NO: 332 - protein, 317 aa, Homo sapiens [sequence omitted]

SEQ ID NO: 333 - protein, 345 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSCKASCKLPVKKATVVYQGERVKIQEKFKNGMLHGDKVSFFCKNKEKKCSYTEDAQCIDGTIEVPKCFKEHSSLAFWKTDASDVKPC

SEQ ID NO: 334 - protein, 301 aa, Homo sapiens
MVFTQAPAEIMGHLRIRSLLARQCLAEFLGVFVLMLLTQGAVAQAVTSGETKGNFFTMFLAGSLAVTIAIYVGGNVSGAHLNPAFSLAMCIVGRLPWVKLPIYILVQLLSAFCASGATYVLYHDALQNYTGGNLTVTGPKETASIFATYPAPYLSLNNGFLDQVLGTGMLIVGLLAILDRRNKGVPAGLEPVVVGMLILALGLSMGANCGIPLNPARDLGPRLFTYVAGWGPEVFSAGNGWWWVPVVAPLVGATVGTATYQLLVALHHPEGPEPAQDLVSAQHKASELETPASAQMLECKL

SEQ ID NO: 335 - protein, 670 aa, Homo sapiens
MGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 336 - protein, 118 aa, Homo sapiens
MASQSQGIQQLLQAEKRAAEKVADARKRKARRLKQAKEEAQMEVEQYRREREHEFQSKQQAAMGSQGNLSAEVEQATRRQVQGMQSSQQRNRERVLAQLLGMVCDVRPQVHPNYRISA

SEQ ID NO: 337 - protein, 77 aa, Homo sapiens
MEVEQYRREREHEFQSKQQAAMGSQGNLSAEVEQATRRQVQGMQSSQQRNRERVLAQLLGMVCDVRPQVHPNYRISA

SEQ ID NO: 338 - protein, 361 aa, Homo sapiens
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 339 - protein, 306 aa, Homo sapiens
MESIFHEKQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 340 - protein, 393 aa, Homo sapiens
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 341 - protein, 1187 aa, Homo sapiens
MRPRGAAFAAGPPGDLHLGTAIGFAGAIWRSRSPAMSTLLDIKSSVLRQVQVCPSFRRRTEQDPGSASADPQEPATGAWKPGDGVEFFAHMRLMLKKGEGRQGLPCLEVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPTEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 342 - protein, 428 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 343 - protein, 428 aa, Homo sapiens; identical to SEQ ID NO: 342

SEQ ID NO: 344 - protein, 543 aa, Homo sapiens
MAHAHIQGGRRAKSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 345 - protein, 616 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 346 - protein, 599 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGEHSDGRPVRPATQGVSNWGGYALACALYILYSCAVHSQYLRKAVGPSRAPGDQAWTQALPSVIKVTNPSQPLAWKQLLPWMSSRPEVPSRKPRAGTLLPLKSQRQSQP

SEQ ID NO: 347 - protein, 609 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYKTTVPCVTHAGFCCPLVVTMRPIPKDKLEGLVRACCSLGELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 348 - protein, 653 aa, Homo sapiens
MGTPQNQTHQQPHVLRAARAEEPAQKLKDKAIKTPKRPGNSTVTSSPPVTPKKLFTSPLCDVSKKSPFRKSKIECPSPGELDQKEPQMSPSVAASLSCPVPSTPPELSQRATLDTVPPPPPSKVGKRCRKTSDPRRSIVECQPDASATPGVGTADSPAAPTDSRDDQKGPSLSPQSPPERRGYPGPGLRSDWHASSPLLITSDTEHVTLLSEAEHHGIGDLKSNVLSVEEGEGLRTADAEKSSLSHPGIPPSPPSCGPGSPLMPSCDVHCTTDGRQCQASAQLDNLPASAWHSTDSASPQTYEVELEMQASGLPKLRIKKIDPSSSLEAEPLSKEESSLGEESFLPALSMPRASRSLSKPEPTYVSPPCPRLSHSTPGKSRGQTYICQACTPTHGPSSTPSPFQTDGVPRTPSPKHSGKTTPDIIKDWPRRKRAVGCGAGSSSGRGEVGADLPGSLSLLETEGKDHGLELSIHRTPILEDFELEGVCQLPDQSPPRNSMPKAEEASSWGQFGLSSRKRVLLAKEEADRGAKRICDLREDSEVSKSKEGSPSWSAWQLPSTGDEEVFVSGSTPPPSCAVRSCLSASALQALTQSPLLFQGKTPSSQSKDPRDEDVDVLPSTVEDSPFSCAFSRRRPISRTYTRKKLMGTWLEDL

SEQ ID NO: 349 - protein, 657 aa, Homo sapiens
MGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 350 - protein, 378 aa, Homo sapiens
MATALPPRLQPVRGNETLREHYQYVGKLAGRLKEASEGSTLTTVLFLVICSFIVLENLMVLIAIWKNNKFHNRMYFFIGNLALCDLLAGIAYKVNILMSGKKTFSLSPTVWFLREGSMFVALGASTCSLLAIAIERHLTMIKMRPYDANKRHRVFLLIGMCWLIAFTLGALPILGWNCLHNLPDCSTILPLYSKKYIAFCISIFTAILVTIVILYARIYFLVKSSSRKVANHNNSERSMALLRTVVIVVSVFIACWSPLFILFLIDVACRVQACPILFKAQWFIVLAVLNSAMNPVIYTLASKEMRRAFFRLVCNCLVRGRGARASPIQPALDPSRSKSSSSNNSSHSPKVKEDLPHTAPSSCIMDKNAALQNGIFCN

SEQ ID NO: 351 - protein, 672 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLSAIRAVAKNTTPGAALPAGEWGTVQLRGSWRVGQTAGGSRNFASYPTNPCFPFSVPEGPGPRCVRITLHQHCRPSDTEFHPIGFHIFQVPEGGRSQDAPPLLLQEPLLSCVPHRYAQEVSRLCLLPAGTYKVVPSTYLPDTEGAFTVTIATRIDRPSIHSQEMLGQFLQEVSVMAVMKT

SEQ ID NO: 352 - protein, 452 aa, Homo sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGDETDRGVDQQDGKNHAGSPGCEESDAGKEKLPKMRLPTRSDMICGYACLKGTAAMRNTKRGSWYIEALAQVFSERACDMHVADMLVKVNALIKDREGYAPGTEFHRCKEMSEYCSTLCRHLYLFPGHPPT

SEQ ID NO: 353 - protein, 108 aa, Homo sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALHS

SEQ ID NO: 354 - protein, 1078 aa, Homo sapiens
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHQPLLPLQCGETDLDLTVQETGLQGPVGGDQRPEVEDPEELSPALVVSSSQSFVISGGGSTVTENVVNS

SEQ ID NO: 355 - protein, 447 aa, Homo sapiens
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 356 - protein, 119 aa, Homo sapiens
MAGLMTIVTSLLFLGVCAHHIIPTGSVVIPSPCCMFFVSKRIPENRVVSYQLSSRSTCLKAGVIFTTKKGQQFCGDPKQEWVQRYMKNLDAKQKKASPRARAVAVKGPVQRYPGNQTTC

SEQ ID NO: 357 - protein, 344 aa, Homo sapiens
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEFVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 358 - protein, 1156 aa, Homo sapiens
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSENSHESADFSAAELISVSKFLPISGMEKEAILSHTEKENGNL

SEQ ID NO: 359 - protein, 1121 aa, Homo sapiens
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPH

SEQ ID NO: 360 - protein, 847 aa, Homo sapiens [sequence omitted]

SEQ ID NO: 361 - protein, 847 aa, Homo sapiens [sequence omitted]

SEQ ID NO: 362 - protein, 488 aa, Homo sapiens
MRQAAVTSTSLTIKSVFTRSELKFSPQWSHHGKIVTCQLQDADGKFLSNDTVQLNVKHPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEDPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 363 - protein, 727 aa, Homo sapiens
MESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEDPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 364 - protein, 742 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 365 - protein, 699 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 366 - protein, 668 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFMPGRGPIHRDQVNCSGAEAYLWDCPGLPGQHYCGHKEDAGVVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELASTQPAFSAGPPADDSSSTSSGEWYQNFQPPPQPPSEEQFGCPGSPSPQPDSTDNDDYDDISAA

SEQ ID NO: 367 - protein, 327 aa, Homo sapiens
MRLAVLFSGALLGLLAESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 368 - protein, 354 aa, Homo sapiens
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 369 - protein, 745 aa, Homo sapiens
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLVVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMELQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 370 - protein, 738 aa, Homo sapiens
MEKSRMNLPKGPDTLCFDKDEFMKEDFDVDHFVSDCRKRVQLEELRDDLELYYKLLKTAMVELINKDYADFVNLSTNLVGMDKALNQLSVPLGQLREEVLSLRSSVSEGIRAVDERMSKQEDIRKKKMCVLRLIQVIRSVEKIEKILNSQSSKETSALEASSPLLTGQILERIATEFNQLQFHAVQSKGMPLLDKVRPRIAGITAMLQQSLEGLLLEGLQTSDVDIIRHCLRTYATIDKTRDAEALVGQVLVKPYIDEVIIEQFVESHPNGLQVMYNKLLEFVPHHCRLLREVTGGAISSEKGNTVPGYDFLVNSVWPQIVQGLEEKLPSLFNPGNPDAFHEKYTISMDFVRRLERQCGSQASVKRLRAHPAYHSFNKKWNLPVYFQIRFREIAGSLEAALTDVLEDAPAESPYCLLASHRTWSSLRRCWSDEMFLPLLVHRLWRLTLQILARYSVFVNELSLRPISNESPKEIKKPLVTGSKEPSITQGNTEDQGSGPSETKPVVSISRTQLVYVVADLDKLQEQLPELLEIIKPKLEMIGFKNFSSISAALEDSQSSFSACVPSLSSKIIQDLSDSCFGFLKSALEVPRLYRRTNKEVPTTASSYVDSALKPLFQLQSGHKDKLKQAIIQQWLEGTLSESTHKYYETVSDVLNSVKKMEESLKRLKQARKTTPANPVGPSGGMSDDDKIRLQLALDVEYLGEQIQKLGLQASDIKSFSALAELVAAAKDQATAEQP

SEQ ID NO: 371 - protein, 423 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQTAKNAIWIDCGIHAREWISPAFCLWFIGHITQFYGIIGQYTNLLRLVDFYVMPVVNVDGYDYSWKKNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKTSKNTRYTHGHGSETLYLAPGGGDDWIYDLGIKYSFTIELRDTGTYGFLLPERYIKPTCREAFAAVSKIAWHVIRNV

SEQ ID NO: 372 - protein, 360 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKISKNTRYTHGHGSETLYLAPGGGDDWIYDLGIKYSFTSNPPVEKLLPLSLK

SEQ ID NO: 373 - protein, 756 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETGIISQGPSSDT

SEQ ID NO: 374 - protein, 773 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETDSHRFGRHLKEAMTDIITLFGLSSNSKK

SEQ ID NO: 375 - protein, 331 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 376 - protein, 3623 aa, Homo sapiens
MMNMSLPFLWSLLTLLIFAEVNGERGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGNCLNLHDSFFCICPPQWKGPLCSADVNECEIYSGTPLSCQNGGTCVNTMGSYSCHCPPETYGPQCASKYDDCEGGSVARCVHGICEDLMREQAGEPKYSCVCDAGWMSSPNSPACTLDRDECSFQPGPCSTLVQCFNTQGSFYCGACPTGWQGNGYICEDINECEINNGGCSVAPPVECVNTPGSSHCQACPPGYQGDGRVCTLTDICSVSNGGCHPDASCSSTLGSLPLCTCLPGYTGNGYGPNGCVQLSNICLSHPCLNGQCIDTVSGYFCKCDSGWTGVNCTENINECLSNPCLNGGTCVDGVDSFSCECTRLWTGALCQVPQQVCGESLSGINGSFSYRSPDVGYVHDVNCFWVIKTEMGKVLRITFTFFRLESMDNCPHEFLQVYDGDSSSAFQLGRFCGSSLPHELLSSDNALYFHLYSEHLRNGRGFTVRWETQQPECGGILTGPYGSIKSPGYPGNYPPGRDCVWIVVTSPDLLVTFTFGTLSLEHHDDCNKDYLEIRDGPLYQDPLLGKFCTTFSVPPLQTTGPFARIHFHSDSQISDQGFHITYLTSPSDLRCGGNYTDPEGELFLPELSGPFTHTRQCVYMMKQPQGEQIQINFTHVELQCQSDSSQNYIEVRDGETLLGKVCGNGTISHIKSITNSVWIRFKIDASVEKASFRAVYQVACGDELTGEGVIRSPFFPNVYPGERTCRWTIHQPQSQVILLNFTVFEIGSSAHCETDYVEIGSSSILGSPENKKYCGTDIPSFITSVYNFLYVTFVKSSSTENHGFMAKFSAEDLACGEILTESTGTIQSPGHPNVYPHGINCTWHILVQPNHLIHLMFETFHLEFHYNCTNDYLEVYDTDSETSLGRYCGKSIPPSLTSSGNSLMLVFVTDSDLAYEGFLINYEAISAATACLQDYTDDLGTFTSPNFPNNYPNNWECIYRITVRTGQLIAVHFTNFSLEEAIGNYYTDFLEIRDGGYEKSPLLGIFYGSNLPPTIISHSNKLWLKFKSDQIDTRSGFSAYWDGSSTGCGGNLTTSSGTFISPNYPMPYYHSSECYWWLKSSHGSAFELEFKDFHLEHHPNCTLDYLAVYDGPSSNSHLLTQLCGDEKPPLIRSSGDSMFIKLRTDEGQQGRGFKAEYRQTCENVVIVNQTYGILESIGYPNPYSENQHCNWTIRATTGNTVNYTFLAFDLEHHINCSTDYLELYDGPRQMGRYCGVDLPPPGSTTSSKLQVLLLTDGVGRREKGFQMQWFVYGCGGELSGATGSFSSPGFPNRYPPNKECIWYIRTDPGSSIQLTIHDFDVEYHSRCNFDVLEIYGGPDFHSPRIAQLCTQRSPENPMQVSSTGNELAIRFKTDLSINGRGFNASWQAVTGGCGGIFQAPSGEIHSPNYPSPYRSNTDCSWVIRVDRYHRVLLNFTDFDLEPQDSCIMAYDGLSSTMSRLARTCGREQLANPIVSSGNSLFLRFQSGPSRQNRGFRAQFRQACGGHILTSSFDTVSSPRFPANYPNNQNCSWIIQAQPPLNHITLSFTHFELERSTTCARDFVEILDGGHEDAPLRGRYCGTDMPHPITSFSSALTLRFVSDSSISAGGFHTTVTASVSACGGTFYMAEGIFNSPGYPDIYPPNVECVWNIISSPGNRLQLSFISFQLEDSQDCSRDFVEIREGNATGHLVGRYCGNSFPLNYSSIVGHTLWVRFISDGSGSGTGFQATFMKIFGNDNIVGTHGKVASPFWPENYPHNSNYQWTVNVNASHVVHGRILEMDIEEIQNCYYDKLRIYDGPSIHARLIGAYCGTQTESFSSTGNSLTFHFYSDSSISGKGFLLEWFAVDAPDGVLPTIAPGACGGFLRTGDAPVFLFSPGWPDSYSNRVDCTWLIQAPDSTVELNILSLDIESHRTCAYDSLVIRDGDNNLAQQLAVLCGREIPGPIRSTGEYMFIRFTSDSSVTRAGFNASFHKSCGGYLHADRGIITSPKYPETYPSNLNCSWHVLVQSGLTIAVHFEQPFQIPNGDSSCNQGDYLVLRNGPDIYSPPLGPPGGNGHFCGSHASSTLFTSDNQMFVQFISDHSNEGQGFKIKYEAKSLACGGNVYIHDADSAGYVTSPNHPHNYPPHADCIWILAAPPETRIQLQFEDRFDIEVTPNCTSNYLELRDGVDSDAPILSKFCGTSLPSSQWSSGEVMYLRFRSDNSPTHVGFKAKYSIAQCGGRVPGQSGVVESIGHPTLPYRDNLFCEWHLQGLSGHYLTISFEDFNLQNSSGCEKDFVEIWDNHTSGNILGRYCGNTIPDSIDTSSNTAVVRFVTDGSVTASGFRLRFESSMEECGGDLQGSIGTFTSPNYPNPNPHGRICEWRITAPEGRRITLMFNNLRLATHPSCNNEHVIVFNGIRSNSPQLEKLCSSVNVSNEIKSSGNTMKVIFFTDGSRPYGGFTASYTSSEDAVCGGSLPNTPEGNFTSPGYDGVRNYSRNLNCEWTLSNPNQGNSSISIHFEDFYLESHQDCQFDVLEFRVGDADGPLMWRLCGPSKPTLPLVIPYSQVWIHFVTNERVEHIGFHAKYSFTDCGGIQIGDSGVITSPNYPNAYDSLTHCSWLLEAPQGHTITLTFSDFDIEPHTTCAWDSVTVRNGGSPESPIIGQYCGNSNPRTIQSGSNQLVVTFNSDHSLQGGGFYATWNTQTLGCGGIFHSDNGTIRSPHWPQNFPENSRCSWTAITHKSKHLEISFDNNFLIPSGDGQCQNSFVKVWAGTEEVDKALLATGCGNVAPGPVITPSNTFTAVFQSQEAPAQGFSASFVSRCGSNFTGPSGYIISPNYPKQYDNNMNCTYVIEANPLSVVLLTFVSFHLEARSAVTGSCVNDGVHIIRGYSVMSTPFATVCGDEMPAPLTIAGPVLLNFYSNEQITDFGFKFSYRIISCGGVFNFSSGIITSPAYSYADYPNDMHCLYTITVSDDKVIELKFSDFDVVPSTSCSHDYLAIYDGANTSDPLLGKFCGSKRPPNVKSSNNSMLLVFKTDSFQTAKGWKMSFRQTLGPQQGCGGYLTGSNNTFASPDSDSNGMYDKNLNCVWIIIAPVNKVIHLTFNTFALEAASTRQRCLYDYVKLYDGDSENANLAGTFCGSTVPAPFISSGNFLTVQFISDLTLEREGFNATYTIMDMPCGGTYNATWTPQNISSPNSSDPDVPFSICTWVIDSPPHQQVKITVWALQLTSQDCTQNYLQLQDSPQGHGNSRFQFCGRNASAVPVFYSSMSTAMVIFKSGVVNRNSRMSFTYQIADCNRDYHKAFGNLRSPGWPDNYDNDKDCTVTLTAPQNHTISLFFHSLGIENSVECRNDFLEVRNGSNSNSPLLGKYCGTLLPNPVFSQNNELYLRFKSDSVTSDRGYEIIWTSSPSGCGGTLYGDRGSFTSPGYPGTYPNNTYCEWVLVAPAGRLVTINFYFISIDDPGDCVQNYLTLYDGPNASSPSSGPYCGGDTSIAPFVASSNQVFIKFHADYARRPSAFRLTWDS

SEQ ID NO: 377 - protein, 355 aa, Homo sapiens
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 378 - protein, 273 aa, Homo sapiens
MSGSQSEVAPSPQSPRSPEMGRDLRPGSRVLLLLLLLLLVYLTQPGNGNEGSVTGSCYCGKRISSDSPPSVQFMNRLRKHLRAYHRCLYYTRFQLLSWSVCGGNKDPWVQELMSCLDLKECGHAYSGIVAHQKHLLPTSPPTSQASEGASSDIHTPAQMLLSTLQSTQRPTLPVGSLSSDKELTRPNETTIHTAGHSLAVGPEAGENQKQPEKNAGPTARTSATVPVLCLLAIIFILTAALSYVLCKRRRGQSPQSSPDLPVHYIPVAPDSNT

SEQ ID NO: 379 - protein, 195 aa, Homo sapiens
MGQIEWAMWANEQALASGLILITGGIVATAGRFTQWYFGAYSIVAGVFVCLLEYPRGKRKKGSTMERWGQKYMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAVAAGGPPGGPQVNPIPVTDEVV

SEQ ID NO: 380 - protein, 520 aa, Homo sapiens
MSQLSLSWLGLWPVAASPWLLLLLVGASWLLAHVLAWTYAFYDNCRRLRCFPQPPRRNWFWGHQGMVNPTEEGMRVLTQLVATYPQGFKVWMGPISPLLSLCHPDIIRSVINASAAIAPKDKFFYSFLEPWLGDGLLLSAGDKWSRHRRMLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPEVYDPFRFDPENIKERSPLAFIPFSAGPRNCIGQTFAMAEMKVVLALTLLRFRVLPDHTEPRRKPELVLRAEGGLWLRVEPLS

SEQ ID NO: 381 - protein, 617 aa, Homo sapiens
MPALSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAKAFYYPEEAGLAFGGPGSSRYLRLEVHYHNPLVIEGRNDSSGIRLYYTAKLRRFNAGIMELGLVYTPVMAIPPRETAFILTGYCTDKCTQLALPPSGIHIFASQLHTHLTGRKVVTVLVRDGREWEIVNQDNHYSPHFQEIRMLKKVVSVHPGDVLITSCTYNTEDRELATVGGFGILEEMCVNYVHYYPQTQLELCKSAVDAGFLQKYFHLINRFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 382 - protein, 766 aa, Homo sapiens
MLGDAVPFSKDWGGREVIGGRREPPARGGEEGAVCSCCLHLRGGRSSRRLRLPPRCPPDMPEEAGFPPAKRFRPGSGPPSRAGSFPPGRQVVMLLTAGSGGRGGGGGRRQQPPLAQPSASPYPEAVELQRRSLPIFQARGQLLAQLRNLDNAVLIGETGSGKTTQIPQYLYEGGISRQGIIAVTQPRRVAAISLATRVSDEKRTELGKLVGYTVRFDDVTSEDTRIKFLTDGMLLREAISDSLLRKYSCVILDEAHERTIHTDVLFGVVKAAQKRRKELGKLPLKVIVMSATMDVDLFSQYFNGAPVLYLEGRQHPIQVFYTKQPQNDYLHAALVSVFQIHQEAPSSQDILVFLTGQEEIEAMSKTCRDIAKHLPDGCPAMLVLPLYASLPYAQQLRVFQGAPKGYRKVIISTNIAETSITITGIKYVVDTGMVKAKKYNPDSGLEVLAVQRVSKTQAWQRTGRAGREDSGICYRLYTEDEFEKFDKMTVPEIQRCNLASVMLQLLAMKVPNVLTFDFMSKPSPDHIQAAIAQLDLLGALEHKDDQLTLTPMGRKMAAFPLEPKFAKTILMSPKFHCTEEILTIVSLLSVDSVLHNPPSRREEVQGVRKKFISSEGDHMTLLNIYRTFKNLGGNKDWCKENFVNSKNMTLVAEVRAQLRDICLKMSMPIASSRGDVESVRRCLAHSLFMSTAELQPDGTYATTDTHQPVAIHPSSVLFHCKPACVVYTELLYTNKCYMRDLCVIDAQWLYEAAPEYFRRKLRTARN

SEQ ID NO: 383 - protein, 3036 aa, Homo sapiens
MHLHQVLTGAVNPGDNCYSVGSVGDVPFTAYGSGCDIVILANDFECVQIIPGAKHGNIQVSCVECSNQQGRIAASYGNAVCIFEPLGINSHKRNCQLKCQWLKTGQFFLSSVTYNLAWDPQDNRLLTTTDSIQLWAPPGDDILEEEEEIDNTVPPVLNDWKCVWQCKTSVSVHLMEWSPDGEYFATAGKDDCLLKVWYPMTGWKSSIIPQDHHEVKRRQSSTQFSFVYLAHPRAVTGFSWRKTSKYMPRGSVCNVLLTSCHDGVCRLWAETLLPEDCLLGEQICETTTSSIASSLSHAGRHKDRIQHALETIHHLKNLRKGQRRSSVLVTHAELMPDQTAMHEVQRHISHHANALCHFHIAASINPATDIPNVLVGTAFNVDDGNGGFVVHWLNNKEFHFTSSTEVFMHQLRKLSDKQVDHENDDADREDEEHSQEDRERGLHMKLDHDLSLDRESEAGTGSSEHEDGEREGSPRTYSRLSVPMPLPTVLLDRKIETLLTEWNKNPDMLFTIHPVDGTFLVWHVKYLDEYNPGIFRQVQVSFSSRIPVAFPSGDASSLSKNIMMYACINATKDSHHTLLHQEGMSVGSPHGSQPHSRSHSTHMNILAPTVMMISKHIDGSLNQWAVTFADKSAFTTVLTVSHKFRYCGHRFHLNDLACHSVLPLLLTSSHHNALLTPELDCQWDSDNKLSRLMDPVKHIKGSSKQPLRNAATRTFHDPNAIYSELILWRVDPIGPLSYTGGVSELARINSLHTSAFSNVAWLPTLIPSYCLGTYCNSASACFVASDGKNLRLYQAVVDARKLLDELSDPESSKLIGEVFNIVSQQSTARPGCIIELDAITNQCGSNTQLLHVFQEDFIIGYKPHKEDMEKKETEIFFQPSQGYRPPPFSEKFFLVVIEKDSNNNSILHMWHLHLKSVQACLAKASEGASSESLLSVPGQKNVDSSPETSPSVSPMPHSSSIANLQTASKLILSFRLVYSQPLDLPESVEVIRATPSAGHLSSSSIYPVCLAPYLVVTTCSDNKVRFWKCCMEANPECNKSDEKEIYHWKRWPLMNDEGEDNSSTVSIVGRPVAVSCSYTGRLAVAYKQPIHHNGFVSKEFSMHVCIFECESTGGSEWVLEQTIHLDDLVKVGSVLDSRVSVDSNLFVYSKSDALLSKDRYLIPNIKHLVHLDWVSKEDGSHILTVGVGANIFMYGRLSGIVTEQTNSKDGVAVITLPLGGSIKQGVKSRWVLLRSIDLVSSVDGTPSLPVSLSWVRDGILVVGMDCEMHVYAQWKHAVKFGDTEADSSNAEEAAMQDHSTFKSNMLARKSVVEGTAISDDVFCSPTVIQDGGLFEAAHVLSPTLPQYHPTQLLELMDLGKVRRAKAILSHLVKCIAGEVAIVRDPDAGEGTKRHLSRTISVSGSTAKETVTVGKDGTRDYTEIDSIPPLPLYALLAADQDTSYRISEESTKIPQSYEDQTVSQPEDQYSELFQIQDIPTDDIDLEPEKRENKSKVINLSQYGPAYFGQEHARVLSSHLMHSSLPGLTRLEQMFLVALADTVATTSTELDESRDKSCSGRDTLDECGLRYLLAMRLHTCLLTSLPPLYRVQLLHQGVSTCHFAWAFHSEAEEELINMIPAIQRGDPQWSELRAMGIGWWVRNINTLRRCIEKVAKASFQRNNDALDAALFYLSMKKKAVVWGLFRSQHDEKMTTFFSHNFNEDRWRKAALKNAFSLLGKQRFEQSAAFFLLAGSLKDAIEVCLEKMEDIQLAMVIARLYESEFETSSTYISILNQKILGCQKDGSGFSCKRLHPDPFLRSLAYWVMKDYTRALDTLLEQTPKEDDEHQVIIKSCNPVAFSFYNYLRTHPLLIRRNLASPEGTLATLGLKTEKNFVDKINLIERKLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSEVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEYAKQSIFRNIGAGVMQIDIIQGNRLFSCGADGTLKTRVLPNAFNIPNRILDIL

SEQ ID NO: 384 - protein, 188 aa, Homo sapiens
MAETSLPELGGEDKATPCPSILELEELLRAGKSSCSRVDEVWPNLFIGDAATANNRFELWKLGITHVLNAAHKGLYCQGGPDFYGSSVSYLGVPAHDLPDFDISAYFSSAADFIHRALNTPGAKVLVHCVVGVSRSATLVLAYLMLHQRLSLRQAVITVRQHRWVFPNRGFLHQLCRLDQQLRGAGQS

SEQ ID NO: 385 - protein, 291 aa, Homo sapiens
MGLCHFATLALILLVLLEALAQADTQKMVEAQRGVGPRACYSIWLLLAPTPPLSHCLQSPQKQHQVCGDRRLKASSTNCPSEKCTAWARYSHRMDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMICENMTLVEAIQTVQAHRNICPNSGFLRQLQVLDNRLGRETGRF

SEQ ID NO: 386 - protein, 378 aa, Homo sapiens; identical to SEQ ID NO: 350

SEQ ID NO: 387 - protein, 78 aa, Homo sapiens
MEKDWNNHKKGKDCSKLGKKCIYQQLVRGRKIRRSSEEHLRQTRSETMRNSVKSSFHDPKLKGKPSRERYVTHNRAHW

SEQ ID NO: 388 - protein, 160 aa, Homo sapiens
MDYLLMIFSLLFVACQGAPETAVLGAELSAVGENGGEKPTPSPPWRLRRSKRCSCSSLMDKECVYFCHLDIIWVNTPEAEDIMEKDWNNHKKGKDCSKLGKKCIYQQLVRGRKIRRSSEEHLRQTRSETMRNSVKSSFHDPKLKGKPSRERYVTHNRAHW

SEQ ID NO: 389 - protein, 212 aa, Homo sapiens
MDYLLMIFSLLFVACQGAPETAVLGAELSAVGENGGEKPTPSPPWRLRRSKRCSCSSLMDKECVYFCHLDIIWVNTPEHVVPYGLGSPRSKRALENLLPTKATDRENRCQCASQKDKKCWNFCQAGKELRAEDIMEKDWNNHKKGKDCSKLGKKCIYQQLVRGRKIRRSSEEHLRQTRSETMRNSVKSSFHDPKLKGKPSRERYVTHNRAHW

SEQ ID NO: 390 - protein, 212 aa, Homo sapiens; identical to SEQ ID NO: 389

SEQ ID NO: 391 - protein, 551 aa, Homo sapiens
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 392 - protein, 826 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 393 - protein, 896 aa, Homo sapiens
MDGAAGPGDGPAREALQSLSQRLRVQEQEMELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 394 - protein, 564 aa, Homo sapiens [sequence omitted]

SEQ ID NO: 395 - protein, 803 aa, Homo sapiens
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREGACSSQSQESGEFSLQSSNASKLSQCSSKDSDSEESDCNIKLLDSQSDQTSKLCLSHFSKKDTPLRNKVPGLYKSSSADSLSTTKIKPLGPARASGLSKKPASIQKRKHHNAENKPGLQIKLNELWKNFGFKKF

SEQ ID NO: 396 - protein, 846 aa, Homo sapiens
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREGACSSQSQESGEFSLQSSNASKLSQCSSKDSDSEESDCNIKLLDSQSDQTSKLCLSHFSKKDTPLRNKVPGLYKSSSADSLSTTKIKPLGPARASGLSKKPASIQKRKHHNAENKPGLQIKLNELWKNFGFKKDSEKLPPCKKPLSPVRDNIQLTPEAEEDIFNKPECGRVQRAIFQ

SEQ ID NO: 397 - protein, 846 aa, Homo sapiens; identical to SEQ ID NO: 396

SEQ ID NO: 398 - protein, 732 aa, Homo sapiens
MSETSRTAFGGRRAVPPNNSNAAEDDLPTVELQGVVPRGVNLQEFLNVTSVHLFKERWDTNKVDHHTDKYENNKLIVRRGQSFYVQIDLSRPYDPRRDLFRVEYVIGRYPQENKGTYIPVPIVSELQSGKWGAKIVMREDRSVRLSIQSSPKCIVGKFRMYVAVWTPYGVLRTSRNPETDTYILFNPWCEDDAVYLDNEKEREEYVLNDIGVIFYGEVNDIKTRSWSYGQFEDGILDTCLYVMDRAQMDLSGRGNPIKVSRVGSAMVNAKDDEGVLVGSWDNIYAYGVPPSAWTGSVDILLEYRSSENPVRYGQCWVFAGVFNTFLRCLGIPARIVTNYFSAHDNDANLQMDIFLEEDGNVNSKLTKDSVWNYHCWNEAWMTRPDLPVGFGGWQAVDSTPQENSDGMYRCGPASVQAIKHGHVCFQFDAPFVFAEVNSDLIYITAKKDGTHVVENVDATHIGKLIVTKQIGGDGMMDITDTYKFQEGQEEERLALETALMYGAKKPLNTEGVMKSRSNVDMDFEVENAVLGKDFKLSITFRNNSHNRYTITAYLSANITFYTGVPKAEFKKETFDVTLEPLSFKKEAVLIQAGEYMGQLLEQASLHFFVTARINETRDVLAKQKSTVLTIPEIIIKVRGTQVVGSDMTVTVQFTNPLKETLRNVWVHLDGPGVTRPMKKMFREIRPNSTVQWEEVCRPWVSGHRKLIASMSSDSLRHVYGELDVQIQRRPSM

SEQ ID NO: 399 - protein, 385 aa, Homo sapiens
MWGRLLLWPLVLGFSLSGGTQTPSVYDESGSTGGGDDSTPSILPAPRGYPGQVCANDSDTLELPDSSRALLLGWVPTRLVPALYGLVLVVGLPANGLALWVLATQAPRLPSTMLLMNLAAADLLLALALPPRIAYHLRGQRWPFGEAACRLATAALYGHMYGSVLLLAAVSLDRYLALVHPLRARALRGRRLALGLCMAAWLMAAALALPLTLQRQTFRLARSDRVLCHDALPLDAQASHWQPAFTCLALLGCFLPLLAMLLCYGATLHTLAASGRRYGHALRLTAVVLASAVAFFVPSNLLLLLHYSDPSPSAWGNLYGAYVPSLALSTLNSCVDPFIYYYVSAEFRDKVRAGLFQRSPGDTVASKASAEGGSRGMGTHSSLLQ

SEQ ID NO: 400 - protein, 2224 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPMDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 401 - protein, 127 aa, Homo sapiens
MSFSGKYQLQSQENFEAFMKAIGLPEELIQKGKDIKGVSEIVQNGKHFKFTITAGSKVIQNEFTVGEECELETMTGEKVKTVVQLEGDNKLVTTFKNIKSVTELNGDIITNTMTLGDIVFKRISKRI

SEQ ID NO: 402 - protein, 605 aa, Homo sapiens
MSNESCLPYYTAHSYSSMSAFKTSMGDLQRQLYNRGEYNIFKYAPMFESNFIQINKKGEVIDVHNRVRMVTVGIVCTSPILPLPDVMVLAQPTKICEQHVRWGRFAKGRGRRPVKTLELTRLLPLKFVKISIHDHEKQQLRLKLATGRTFYLQLCPSSDTREDLFCYWEKLVYLLRPPVESYCSTPTLLSGDAPPEDNKSLVAAELHREGDQSETGLYKPCDVSAATSSAYAGGEGIQHASHGTASAASPSTSTPGAAEGGAARTAGGMAVAGTATGPRTDVAIAGAAMSPATGAMSIATTKSAGPGQVTTALAGAAIKNPGENESSKSMAGAANISSEGISLALVGAASTSLEGTSTSMAGAASLSQDSSLSAAFAGSITTSKCAAERTEGPAVGPLISTLQSEGYMSERDGSQKVSQPSAEVWNENKERREKKDRHPSRKSSHHRKAGESHRRRAGDKNQKASSHRSASGHKNTRDDKKEKGYSNVRGKRHGSSRKSSTHSSTKKESRTTQELGKNQSASSTGALQKKASKISSFLRSLRATPGSKTRVTSHDREVDIVAKTVEKQNIEAKVEKAQGGQELEMISGTMTSEKTEMIVFETKSI

SEQ ID NO: 403 - protein, 4349 aa, Homo sapiens
MTIALLGFAIFLLHCATCEKPLEGILSSSAWHFTHSHYNATIYENSSPKTYVESFEKMGIYLAEPQWAVRYRIISGDVANVFKTEEYVVGNFCFLRIRTKSSNTALLNREVRDSYTLIIQATEKTLELEALTRVVVHILDQNDLKPLFSPPSYRVTISEDMPLKSPICKVTATDADLGQNAEFYYAFNTRSEMFAIHPTSGVVTVAGKLNVTWRGKHELQVLAVDRMRKISEGNGFGSLAALVVHVEPALRKPPAIASVVVTPPDSNDGTTYATVLVDANSSGAEVESVEVVGGDPGKHFKAIKSYARSNEFSLVSVKDINWMEYLHGFNLSLQARSGSGPYFYSQIRGFHLPPSKLSSLKFEKAVYRVQLSEFSPPGSRVVMVRVTPAFPNLQYVLKPSSENVGFKLNARTGLITTTKLMDFHDRAHYQLHIRTSPGQASTVVVIDIVDCNNHAPLFNRSSYDGTLDENIPPGTSVLAVTATDRDHGENGYVTYSIAGPKALPFSIDPYLGIISTSKPMDYELMKRIYTFRVRASDWGSPFRREKEVSIFLQLRNLNDNQPMFEEVNCTGSIRQDWPVGKSIMTMSAIDVDELQNLKYEIVSGNELEYFDLNHFSGVISLKRPFINLTAGQPTSYSLKITASDGKNYASPTTLNITVVKDPHFEVPVTCDKTGVLTQFTKTILHFIGLQNQESSDEEFTSLSTYQINHYTPQFEDHFPQSIDVLESVPINTPLARLAATDPDAGFNGKLVYVIADGNEEGCFDIELETGLLTVAAPLDYEATNFYILNVTVYDLGTPQKSSWKLLTVNVKDWNDNAPRFPPGGYQLTISEDTEVGTTIAELTTKDADSEDNGRVRYTLLSPTEKFSLHPLTGELVVTGHLDRESEPRYILKVEARDQPSKGHQLFSVTDLIITLEDVNDNSPQCITEHNRLKVPEDLPPGTVLTFLDASDPDLGPAGEVRYVLMDGAHGTFRVDLMTGALILERELDFERRAGYNLSLWASDGGRPLARRTLCHVEVIVLDVNENLHPPHFASFVHQGQVQENSPSGTQVIVVAAQDDDSGLDGELQYFLRAGTGLAAFSINQDTGMIQTLAPLDREFASYYWLTVLAVDRGSVPLSSVTEVYIEVTDANDNPPQMSQAVFYPSIQEDAPVGTSVLQLDAWDPDSSSKGKLTFNITSGNHMGFFMIHPVTGLLSTAQQLDRENKDEHILEVTVLDNGEPSLKSTSRVVVGILDVNDNPPIFSHKLFNVRLPERLSPVSPGPVYRLVASDLDEGLNGRVTYSIEDSDEEAFSIDLVTGVVSSSSTFTAGEYNILTIKATDSGQPPLSASVRLHIEWIPWPRPSSIPLAFDETYYSFTVMETDPVNHMVGVISVEGRPGLFWFNISGGDKDMDFDIEKTTGSIVIARPLDTRRRSNYNLTVEVTDGSRTIATQVHIFMIANINHHRPQFLETRYEVRVPQDTVPGVELLRVQAIDQDKGKSLIYTIHGSQDPGSASLFQLDPSSGVLVTVGKLDLGSGPSQHTLTVMVRDQEIPIKRNFVWVTIHVEDGNLHPPRFTQLHYEASVPDTIAPGTELLQVRAMDADRGVNAEVHYSLLKGNSEGFFNINALLGIITLAQKLDQANHAPHTLTVKAEDQGSPQWHDLATVIIHVYPSDRSAPIFSKSEYFVEIPESIPVGSPILLVSAMSPSEVTYELREGNKDGVFSMNSYSGLISTQKKLDHEKISSYQLKIRGSNMAGAFTDVMVVVDIIDENDNAPMFLKSTFVGQISEAAPLYSMIMDKNNNPFVIHASDSDKEANSLLVYKILEPEALKFFKIDPSMGTLTIVSEMDYESMPSFQFCVYVHDQGSPVLFAPRPAQVIIHVRDVNDSPPRFSEQIYEVAIVGPIHPGMELLMVRASDEDSEVNYSIKTGNADEAVTIHPVTGSISVLNPAFLGLSRKLTIRASDGLYQDTALVKISLTQVLDKSLQFDQDVYWAAVKENLQDRKALVILGAQGNHLNDTLSYFLLNGTDMFHMVQSAGVLQTRGVAFDREQQDTHELAVEVRDNRTPQRVAQGLVRVSIEDVNDNPPKFKHLPYYTIIQDGTEPGDVLFQVSATDEDLGTNGAVTYEFAEDYTYFRIDPYLGDISLKKPFDYQALNKYHLKVIARDGGTPSLQSEEEVLVTVRNKSNPLFQSPYYKVRVPENITLYTPILHTQARSPEGLRLIYNIVEEEPLMLFTTDFKTGVLTVTGPLDYESKTKHVFTVRATDTALGSFSEATVEVLVEDVNDNPPTFSQLVYTTSISEGLPAQTPVIQLLASDQDSGRNRDVSYQIVEDGSDVSKFFQINGSTGEMSTVQELDYEAQQHFHVKVRAMDKGDPPLTGETLVVVNVSDINDNPPEFRQPQYEANVSELATCGHLVLKVQAIDPDSRDTSRLEYLILSGNQDRHFSINSSSGIISMFNLCKKHLDSSYNLRVGASDGVFRATVPVYINTTNANKYSPEFQQHLYEAELAENAMVGTKVIDLLAIDKDSGPYGTIDYTIINKLASEKFSINPNGQIATLQKLDRENSTERVIAIKVMARDGGGRVAFCTVKIILTDENDNPPQFKASEYTVSIQSNVSKDSPVIQVLAYDADEGQNADVTYSVNPEDLVKDVIEINPVTGVVKVKDSLVGLENQTLDFFIKAQDGGPPHWNSLVPVRLQVVPKKVSLPKFSEPLYTFSAPEDLPEGSEIGIVKAVAAQDPVIYSLVRGTTPESNKDGVFSLDPDTGVIKVRKPMDHESTKLYQIDVMAHCLQNTDVVSLVSVNIQVGDVNDNRPVFEADPYKAVLTENMPVGTSVIQVTAIDKDTGRDGQVSYRLSADPGSNVHELFAIDSESGWITTLQELDCETCQTYHFHVVAYDHGQTIQLSSQALVQVSITDENDNAPRFASEEYRGSVVENSEPGELVATLKTLDADISEQNRQVTCYITEGDPLGQFGISQVGDEWRISSRKTLDREHTAKYLLRVTASDGKFQASVTVEIFVLDVNDNSPQCSQLLYTGKVHEDVFPGHFILKVSATDLDTDTNAQITYSLHGPGAHEFKLDPHTGELTTLTALDRERKDVFNLVAKATDGGGRSCQADITLHVEDVNDNAPRFFPSHCAVAVFDNTTVKTPVAVVFARDPDQGANAQVVYSLPDSAEGHFSIDATTGVIRLEKPLQVRPQAPLELTVRASDLGTPIPLSTLGTVTVSVVGLEDYLPVFLNTEHSVQVPEDAPPGTEVLQLATLTRPGAEKTGYRVVSGNEQGRFRLDARTGILYVNASLDFETSPKYFLSIECSRKSSSSLSDVTTVMVNITDVNEHRPQFPQDPYSTRVLENALVGDVILTVSATDEDGPLNSDITYSLIGGNQLGHFTIHPKKGELQVAKALDREQASSYSLKLRATDSGQPPLHEDTDIAIQVADVNDNPPRFFQLNYSTTVQENSPIGSKVLQLILSDPDSPENGPPYSFRITKGNNGSAFRVTPDGWLVTAEGLSRRAQEWYQLQIQASDSGIPPLSSSTSVRVHVTEQSHYAPSALPLEIFITVGEDEFQGGMVGKIHATDRDPQDTLTYSLAEEETLGRHFSVGAPDGKIIAAQGLPRGHYSFNVTVSDGTFTTTAGVHVYVWHVGQEALQQAIWMGFYQLTPEELVSDHWRNLQRFLSHKLDIKRANIHLASLQPAEAVAGVDVLLVFEGHSGTFYEFQELASIITHSAKEMEHSVGVQMRSAMPMVPCQGPTCQGQICHNTVHLDPKVGPTYSTARLSILTPRHHLQRSCSCNGTATRFSGQSYVRYRAPAARNWHIHFYLKTLQPQAILLFTNETASVSLKLASGVPQLEYHCLGGFYGNLSSQRHVNDHEWHSILVEEMDASIRLMVDSMGNTSLVVPENCRGLRPERHLLLGGLILLHSSSNVSQGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQELLIITVAVAFIIISTVGLLFYCRRCKSHKPVAMEDPDLLARSVGVDTQAMPAIELNPLSASSCNNLNQLEPSKASVPNELVTFGPNSKQRPVVCSVPPRLPPAAVPSHSDNEPVIKRTWSSEEMVYPGGAMVWPPTYSRNERWEYPHSEVTQGPLPPSAHRHSTPVVMPEPNGLYGGFPFPLEMENKRAPLPPRYSNQNLEDLMPSRPPSPRERLVAPCLNEYTAISYYHSQFRQGGGGPCLADGGYKGVGMRLSRAGPSYAVCEVEGAPLAGQGQPRVPPNYEGSDMVESDYGSCEEVMF

SEQ ID NO: 404 - protein, 133 aa, Homo sapiens
MQLFVRAQELHTFEVTGQETVAQIKAHVASLEGIAPEDQVVLLAGAPLEDEATLGQCGVEALTTLEVAGRMLGGKVHGSLARAGKVRGQTPKVAKQEKKKKKTGRAKRRMQYNRRFVNVVPTFGKKKGPNANS

SEQ ID NO: 405 - protein, 703 aa, Homo sapiens
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATLQQEKTDTVRCIKSCRPNDVTCVFDPVHTISHTVISLPTFREFTRPEEIIFLRAITPPHPASQANIIFDITEGNLRDSFDIIKRYMDGMTVGVVRQVRPIVGPFHAVLKLEMNYVVGGVVSHRNVVNVHIFVSEYWF

SEQ ID NO: 406 - protein, 287 aa, Homo sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 407 - protein, 265 aa, Homo sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYDSIHQDYTTQNLIRMAVAGLVLVALLAILVENWHSHTALNKEASADVAEPSWSQQMCQPGLTFARTPSVCK

SEQ ID NO: 408 - protein, 191 aa, Homo sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTDSIHQDYTTQNLIRMAVAGLVLVALLAILVENWHSHTALNKEASADVAEPSWSQQMCQPGLTFARTPSVCK

SEQ ID NO: 409 - protein, 275 aa, Homo sapiens
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 410 - protein, 179 aa, Homo sapiens
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTDSIHQDYTTQNLIRMAVAGLVLVALLAILVENWHSHTALNKEASADVAEPSWSQQMCQPGLTFARTPSVCK

SEQ ID NO: 411 - protein, 209 aa, Homo sapiens
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRLHPPRLHDAELDPHGRGRTGPRGSLGHTG

SEQ ID NO: 412 - protein, 253 aa, Homo sapiens
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYDSIHQDYTTQNLIRMAVAGLVLVALLAILVENWHSHTALNKEASADVAEPSWSQQMCQPGLTFARTPSVCK

SEQ ID NO: 413 - protein, 239 aa, Homo sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTGRYRPVQPCVWVGCPGPCHRAGI

SEQ ID NO: 414 - protein, 2602 aa, Homo sapiens
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 415 - protein, 2355 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 416 - protein, 657 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPVSIPPRNLGY

SEQ ID NO: 417 - protein, 2176 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 418 - protein, 2421 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 419 - protein, 2296 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 420 - protein, 2330 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 421 - protein, 2477 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 422 - protein, 332 aa, Homo sapiens
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFERLMSINYLGSVYPSRAVITTMKERRVGRIVFVSSQAGQLGLFGFTAYSASKFAIRGLAEALQMEVKPYNVYITVAYPPDTDTPGFAEENRTKPLETRLISETTSVCKPEQVAKQIVKDAIQGNFNSSLGSDGYMLSALTCGMAPVTSITEGLQQVVTMGLFRTIALFYLGSFDSIVRRCMMQREKSENADKTA

SEQ ID NO: 423 - protein, 210 aa, Homo sapiens
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSSGPKRYDWTGKNWVYSHDGVSLHELLAAELTKALKTKLDLSSLAYSGKDA

SEQ ID NO: 424 - protein, 196 aa, Homo sapiens
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSRYVVDLSVMTGLGKTGCTPTTACPSMSCWPQSSLKP

SEQ ID NO: 425 - protein, 685 aa, Homo sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 426 - protein, 407 aa, Homo sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMVNFCCCYWINSLLYYWKNKI

SEQ ID NO: 427 - protein, 561 aa, Homo sapiens
MRHCINCCIQLLPDGAHKQQVNCQGGPHHGHQACPTCKGENKILFRVDSKQMNLLAVLEVRTEGNENWGGFLRFKKGKRCSLVFGLIIMTLVMASYILSGAHQELLISSPFHYGGFPSNPSLMDSENPSDTKEHHHQSSVNNISYMKDYPSIKLIINSITTRIEFTTRQLPDLEDLKKQELHMFSVIPNKFLPNSKSPCWYEEFSGQNTTDPYLTNSYVLYSKRFRSTFDALRKAFWGHLAHAHGKHFRLRCLPHFYIIGQPKCGTTDLYDRLRLHPEVKFSAIKEPHWWTRKRFGIVRLRDGLRDRYPVEDYLDLFDLAAHQIHQGLQASSAKEQSKMNTIIIGEASASTMWDNNAWTFFYDNSTDGEPPFLTQDFIHAFQPNARLIVMLRDPVERLYSDYLYFASSNKSADDFHEKVTEALQLFENCMLDYSLRACVYNNTLNNAMPVRLQVGLYAVYLLDWLSVFDKQQFLILRLEDHASNVKYTMHKVFQFLNLGPLSEKQEALMTKSPASNARRPEDRNLGPMWPITQKILRDFYRPFNARLAQVLADEAFAWKTT

SEQ ID NO: 428 - protein, 536 aa, Homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 429 - protein, 536 aa, Homo sapiens; identical to SEQ ID NO: 428

SEQ ID NO: 430 - protein, 536 aa, Homo sapiens; identical to SEQ ID NO: 428

SEQ ID NO: 431 - protein, 536 aa, Homo sapiens; identical to SEQ ID NO: 428

SEQ ID NO: 432 - protein, 536 aa, Homo sapiens; identical to SEQ ID NO: 428

SEQ ID NO: 433 - protein, 308 aa, Homo sapiens
MPGQELRTVNGSQMLLVLLVLSWLPHGGALSLAEASRASFPGPSELHSEDSRFRELRKRYEDLLTRLRANQSWEDSNTDLVPAPAVRILTPEVRLGSGGHLHLRISRAALPEGLPEASRLHRALFRLSPTASRSWDVTRPLRRQLSLARPQAPALHLRLSPPPSQSDQLLAESSSARPQLELHLRPQAARGRRRARARNGDDCPLGPGRCCRLHTVRASLEDLGWADWVLSPREVQVTMCIGACPSQFRAANMHAQIKTSLHRLKPDTEPAPCCVPASYNPMVLIQKTDTGVSLQTYDDLLAKDCHCI

SEQ ID NO: 434 - protein, 333 aa, Homo sapiens
MGDWGFLEKLLDQVQEHSTVVGKIWLTVLFIFRILILGLAGESVWGDEQSDFECNTAQPGCTNVCYDQAFPISHIRYWVLQFLFVSTPTLVYLGHVIYLSRREERLRQKEGELRALPAKDPQVERALAAVERQMAKISVAEDGRLRIRGALMGTYVASVLCKSVLEAGFLYGQWRLYGWTMEPVFVCQRAPCPYLVDCFVSRPTEKTIFIIFMLVVGLISLVLNLLELVHLLCRCLSRGMRARQGQDAPPTQGTSSDPYTDQVFFYLPVGQGPSSPPCPTYNGLSSSEQNWANLTTEERLASSRPPLFLDPPPQNGQKPPSRPSSSASKKQYV

SEQ ID NO: 435 - protein, 195 aa, Homo sapiens
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKVGSLLGDREKASCFSLIQQFSNCVYILITCPQIVIF

SEQ ID NO: 436 - protein, 212 aa, Homo sapiens
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGGMLLTCVVMFLVVQYLT

SEQ ID NO: 437 - protein, 213 aa, Homo sapiens
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGTQGSCQTAHFGGRSAGSS

SEQ ID NO: 438 - protein, 798 aa, Homo sapiens
MAASLPGPGSRLFRTYGAADGRRQRRPGREAAQWFPPQDRRRFFNSSGSSDASIGDPSQSDDPDDPDDPDFPGSPVRRRRRRPGGRVPKDRPSLTVTPKRWKLRARPSLTVTPRRLGLRARPPQKCSTPCGPLRLPPFPSRDSGRLSPDLSVCGQPRDGDELGISASLFSSLASPCPGSPTPRDSVISIGTSACLVAASAVPSGLHLPEVSLDRASLPCSQEEATGGAKDTRMVHQTRASLRSVLFGLMNSGTPEDSEFRADGKNMRESCCKRKLVVGNGPEGPGLSSTGKRRATGQDSCQERGLQEAVRREHQEASVPKGRIVPRGIDRLERTRSSRKSKHQEATETSLLHSHRFKKGQKLGKDSFPTQDLTPLQNVCFWTKTRASFSFHKKKIVTDVSEVCSIYTTATSLSGSLLSECSNRPVMNRTSGAPSSWHSSSMYLLSPLNTLSISNKKASDAEKVYGECSQKGPVPFSHCLPTEKLQRCEKIGEGVFGEVFQTIADHTPVAIKIIAIEGPDLVNGSHQKTFEEILPEIIISKELSLLSGEVCNRTEGFIGLNSVHCVQGSYPPLLLKAWDHYNSTKGSANDRPDFFKDDQLFIVLEFEFGGIDLEQMRTKLSSLATAKSILHQLTASLAVAEASLRFEHRDLHWGNVLLKKTSLKKLHYTLNGKSSTIPSCGLQVSIIDYTLSRLERDGIVVFCDVSMDEDLFTGDGDYQFDIYRLMKKENNNRWGEYHPYSNVLWLHYLTDKMLKQMTFKTKCNTPAMKQIKRKIQEFHRTMLNFSSATDLLCQHSLFK

SEQ ID NO: 439 - protein, 2071 aa, Homo sapiens
MELAHSLLLNEEALAQITEAKRPVFIFEWLRFLDKVLVAANKTDVKEKQKKLVEQLTGLISSSPGPPTRKLLAKNLAALYSIGDTFTVFQTLDKCNDIIRNKDDTAAYLPTKLAAVACVGAFYEKMGRMLGSAFPETVNNLLKSLKSAESQGRSEILMSLQKVLSGLGGAAASSHRDIYKNARSLLTDRSMAVRCAVAKCLLELQNEAVFMWTAELENIATLCFKALENSNYGVRVAVSKLLGTVMATALMPKQATVMRQNVKRATFDEVLELMATGFLRGGSGFLKSGGEMLKVGGSVNREVRVGVTQAYVVFVTTLGGQWLERSFATFLSHVLDLVSHPRATQTHVEAVYSRRCVSFILRATVGSLLGEKAQIAAAKEICQAIGKQMKAVEAVVNDTSGENKSGAADIAASQHVMVCALQELGSLVQSLNATASPLIQEASIGLLEIVTSVLLHPSMAARLAAAWCLRCVAVALPFQLTPFLDRCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 440 - protein, 260 aa, Homo sapiens
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 441 - protein, 261 aa, Homo sapiens
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNDQEETAGVVSTPLIRNGDWTFQILVMLEMTPQRGDVYTCHVEHPSLQSPITVEWRAQSESAQSKMLSGIGGFVLGLIFLGLGLIIHHRSQKGLLH

SEQ ID NO: 442 - protein, 254 aa, Homo sapiens
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGLRKSNAAERRGPL

SEQ ID NO: 443 - protein, 700 aa, Homo sapiens [sequence omitted]

SEQ ID NO: 444 - protein, 646 aa, Homo sapiens
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 445 - protein, 493 aa, Homo sapiens
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGMPGGMPGGFPGGGAPPSGGASSGPTIEEVD

SEQ ID NO: 446 - protein, 4391 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 447 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 448 - protein, 63 aa, Homo sapiens
MCQAWGNPLPELKCLKDGTFPLPIGESVTVTRDLEGTYLCRARSTQGEVTRKPPGMRLSSSLW

SEQ ID NO: 449 - protein, 223 aa, Homo sapiens
MEVQKEAQRIMTLSVWKMYHSRMQRGGLRLHRSLQLSLVMRSARELYLSAKVEALEPEVSLPAALPSDPRLHPPREAESTAETATPDGEHPFPEPMDTQEAPTAEETSACCAPRPAKVSRKRRSSSLSDGGDAGLVPSKKARLEEKEEEEGASSEVADRLQPPPAQAEGAFPNLARVLQRRFSGLLNCSPAAPPTAPPACEAKPACRPADSMLNVLVRAVVAF

SEQ ID NO: 450 - protein, 272 aa, Homo sapiens
MVLLTAVLLLLAAYAGPAQSLGSFVHCEPCDEKALSMCPPSPLGCELVKEPGCGCCMTCALAEGQSCGVYTERCAQGLRCLPRQDEEKPLHALLHGRGVCLNEKSYREQVKIERDSREHEEPTTSEMAEETYSPKIFRPKHTRISELKAEAVKKDRRKKLTQSKFVGGAENTAHPRIISAPEMRQESEQGPCRRHMEASLQELKASPRMVPRAVYLPNCDRKGFYKRKQCKPSRGRKRGICWCVDKYGMKLPGMEYVDGDFQCHTFDSSNVE

SEQ ID NO: 451 - protein, 152 aa, Homo sapiens
MCSLPMARYYIIKYADQKALYTRDGQLLVGDPVADNCCAEKICILPNRGLARTKVPIFLGIQGGSRCLACVETEEGPSLQLEDVNIEELYKGGEEATRFTFFQSSSGSAFRLEAAAWPGWFLCGPAEPQQPVQLTKESEPSARTKFYFEQSW

SEQ ID NO: 452 - protein, 152 aa, Homo sapiens; identical to SEQ ID NO: 451

SEQ ID NO: 453 - protein, 159 aa, Homo sapiens
MALETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 454 - protein, 180 aa, Homo sapiens
MALADLYEEGGGGGGEGEDNADSKETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 455 - protein, 177 aa, Homo sapiens
MEICRGLRSHLITLLLFLFHSETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 456 - protein, 143 aa, Homo sapiens
MQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 457 - protein, 144 aa, Homo sapiens
MLLAMVLTSALLLCSVAGQGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

SEQ ID NO: 458 - protein, 1181 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 459 - protein, 1032 aa, Homo sapiens [sequence omitted]

SEQ ID NO: 460 - protein, 1035 aa, Homo sapiens
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGWIIAISLLVGILIFLLLAVLLWKMGFFRRRYKEIIEAEKNRKENEDSWDWVQKNQ

SEQ ID NO: 461 - protein, 1179 aa, Homo sapiens
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYVAGAPQYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVAAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 462 - protein, 788 aa, Homo sapiens
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 463 - protein, 1124 aa, Homo sapiens
MAPPSEETPLIPQRSCSLLSTEAGALHVLLPARGPGPPQRLSFSFGDHLAEDLCVQAAKASGILPVYHSLFALATEDLSCWFPPSHIFSVEDASTQVLLYRIRFYFPNWFGLEKCHRFGLRKDLASAILDLPVLEHLFAQHRSDLVSGRLPVGLSLKEQGECLSLAVLDLARMAREQAQRPGELLKTVSYKACLPPSLRDLIQGLSFVTRRRIRRTVRRALRRVAACQADRHSLMAKYIMDLERLDPAGAAETFHVGLPGALGGHDGLGLLRVAGDGGIAWTQGEQEVLQPFCDFPEIVDISIKQAPRVGPAGEHRLVTVTRTDNQILEAEFPGLPEALSFVALVDGYFRLTTDSQHFFCKEVAPPRLLEEVAEQCHGPITLDFAINKLKTGGSRPGSYVLRRSPQDFDSFLLTVCVQNPLGPDYKGCLIRRSPTGTFLLVGLSRPHSSLRELLATCWDGGLHVDGVAVTLTSCCIPRPKEKSNLIVVQRGHSPPTSSLVQPQSQYQLSQMTFHKIPADSLEWHENLGHGSFTKIYRGCRHEVVDGEARKTEVLLKVMDAKHKNCMESFLEAASLMSQVSYRHLVLLHGVCMAGDSTMVQEFVHLGAIDMYLRKRGHLVPASWKLQVVKQLAYALNYLEDKGLPHGNVSARKVLLAREGADGSPPFIKLSDPGVSPAVLSLEMLTDRIPWVAPECLREAQTLSLEADKWGFGATVWEVFSGVTMPISALDPAKKLQFYEDRQQLPAPKWTELALLIQQCMAYEPVQRPSFRAVIRDLNSLISSDYELLSDPTPGALAPRDGLWNGAQLYACQDPTIFEERHLKYISQLGKGNFGSVELCRYDPLGDNTGALVAVKQLQHSGPDQQRDFQREIQILKALHSDFIVKYRGVSYGPGRQSLRLVMEYLPSGCLRDFLQRHRARLDASRLLLYSSQICKGMEYLGSRRCVHRDLAARNILVESEAHVKIADFGLAKLLPLDKDYYVVREPGQSPIFWYAPESLSDNIFSRQSDVWSFGVVLYELFTYCDKSCSPSAEFLRMMGCERDVPALCRLLELLEEGQRLPAPPACPAEVHELMKLCWAPSPQDRPSFSALGPQLDMLWSGSRGCETHAFTAHPEGKHHSLSFS

SEQ ID NO: 464 - protein, 191 aa, Homo sapiens
MVKKLVMAQKRGETRALCLGVTMVVCAVITYYILVTTVLPLYQKSVWTQESKCHLIETNIRDQEELKGKKVPQYPCLWVNVSAAGRWAVLYHTEDTRDQNQQCSYIPGSVDNYQTARADVEKVRAKFQEQQVFYCFSAPRGNETSVLFQRLYGPQALLFSLFWPTFLLTGGLLIIAMVKSNQYLSILAAQK

SEQ ID NO: 465 - protein, 225 aa, Homo sapiens
MSTVVELNVGGEFHTTTLGTLRKFPGSKLAEMFSSLAKASTDAEGRFFIDRPSTYFRPILDYLRTGQVPTQHIPEVYREAQFYEIKPLVKLLEDMPQIFGEQVSRKQFLLQVPGYSENLELMVRLARAEAITARKSSVLVCLVETEEQDAYYSEVLCFLQDKKMFKSVVKFGPWKAVLDNSDLMHCLEMDIKAQGYKVFSKFYLTYPTKRNEFHFNIYSFTFTWW

SEQ ID NO: 466 - protein, 1356 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 467 - protein, 1356 aa, Homo sapiens; identical to SEQ ID NO: 466

SEQ ID NO: 468 - protein, 1306 aa, Homo sapiens [sequence omitted]

SEQ ID NO: 469 - protein, 1359 aa, Homo sapiens
MYSVEDLLISHGYKLSRDPPASREDNPKGRQAARTGTRAGQGLQNGHEDGPAALAHRKTSAGKGHVSDSESRRSTPRGHGEPQSTSASRTSEAGFCNQPPSAWSSHPPTGNDQAYRRRGRQEARSQKPREHENLEARGMAQAHSLPVHVREGPWEVGGRSEHVMKKPVWEEELRMSGPAKWQNVSLESWNQPRKLGRQMSDGDGERLFQDLYPFIQGEHVLNSQNKGKSRSLPRVLSPESLSCTEIPIPLNERHSPKMPPYPPTCAPNLDSTRNSEKSGCSAPFPRPKFGRPLKPPSYSSHQQSRGGADSSDSQDSQQMDAYVPRHELCLSDPGLEPPVYVPPPSYRSPPQNIPNPYLEDTVPINVCGGHSQQQSPTEKAGASGQPPSGPPGTGNEYGVSPRLPQGLPAHPRPVTAYDGFVQYIPFDDPRLRHFKLAQPQGFCEDIKLDDKSYNSSPVTAQEPAHGGMQPDGAIWNPQSLIPPSGDERGLVLADSSPRWLWGQPPGDGENSGLPNQRDRCVARGQWPDVRGSQHGHTGRQVSSPYSQGESTCETQTKLKKFQTGTRTKKSSKKKMNETIFCLVSIPVKSESHLPDRDMDNNDLKPSADQKNGSDKSPALQEQSLLSMSSTDLELQALTGSMGGRTEFQKQDLGEPEEDRQTNDLSFIHLTKHRELKHSGSWPGHRYRDQQTQTSFSEEPQSSQLLPGAKLGGPSRAALSPKCSDPAASEAQTHTAFPTGDHKQRPSARNLKGHRSLSPSSNSAFSRTSLSVDQAPTPKAGRSQPCVDVHGLGAHPGPKREVVKGEPTGPCNSKQLFGQFLLKPVSRRPWDLISQLESFNKELQEEEESSSSSSSSSSSSEESEAEPQQENRAHCRQEDVGFRGNSPEMRVEPQPRMWVPESPVCRSGRGESKSESWSEELQPGHPRAWPPSPGRFRVEEGGGAPFCSADGSTSAEKRHLEVSNGMDELAGSPFPVTRMSSRSSDAKPLPASYPAEPREPQESPKITSAFSSVKPSEAVPRKFDSGGERGAGLPLSLSNKNRGLSAPDLRSVGLTPGQEQGASELEGSLGEASTIEIPPGESLQARAARILGIEVAVESLLPGIRRAGQNQPAEPDASACTPESPQEELLSRPAPADVPRVSTDAFYGRRKCGWTKSPLFVGDRDSARRAPQAFEHSDVDGVVTSTDPVPEPEPSPLESKFFEQKDVETKPPFRSTLFHFVERTPSVAGSEKRLRSPSKVIESLQEKLASPPRRADPDRLMRMKEVSSVSRMRVLSFRNADSQEDAEELKATTRGQAGLPGGLVSPGSGDRAQRLGHSLSVSKDSISREEKEHPAAQKEKSMDQDFWCPDSYDPSRVERV

SEQ ID NO: 470 - protein, 1012 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSLLAFIAFLFFASIISLSLIFYYSKKGRRSYK

SEQ ID NO: 471 - protein, 573 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGGVSGRASFCGKRQQQQWPGRRHR

SEQ ID NO: 472 - protein, 262 aa, Homo sapiens
MWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 473 - protein, 276 aa, Homo sapiens
MRAPHLHLSAASGARALAKLLPLLMAQLWAAEAALLPQNDTRLDPEAYGSPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVLGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 474 - protein, 276 aa, Homo sapiens; identical to SEQ ID NO: 473

SEQ ID NO: 475 - protein, 276 aa, Homo sapiens; identical to SEQ ID NO: 473

SEQ ID NO: 476 - protein, 267 aa, Homo sapiens
MSLRVLGSGTWPSAPKMFLLLTALQVLAIAMTQSQEDENKIIGGHTCTRSSQPWQAALLAGPRRRFLCGGALLSGQWVITAAHCGRPILQVALGKHNLRRWEATQQVLRVVRQVTHPNYNSRTHDNDLMLLQLQQPARIGRAVRPIEVTQACASPGTSCRVSGWGTISSPIARYPASLQCVNINISPDEVCQKAYPRTITPGMVCAGVPQGGKDSCQGDSGGPLVCRGQLQGLVSWGMERCALPGYPGVYTNLCKYRSWIEETMRDK

SEQ ID NO: 477 - protein, 256 aa, Homo sapiens
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQVSLPDTLHCANISIISDTSCDKSYPGRLTNTMVCAGAEGRGAESCEGDSGGPLVCGGILQGIVSWGDVPCDNTTKPGVYTKVCHYLEWIRETMKRN

SEQ ID NO: 478 - protein, 161 aa, Homo sapiens
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQG

SEQ ID NO: 479 - protein, 171 aa, Homo sapiens
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQGDSGGPLVCGGILQGIVSWGDVPCDNTTKPGVYTKVCHYLEWIRETMKRN

SEQ ID NO: 480 - protein, 3695 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPKGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVFLRRVALEVASPAGQGALASNVELCLCPASYRGDSCQECAPGFYRDVKGLFLGRCVPCQCHGHSDRCLPGSGVCVDCQHNTEGAHCERCQAGFVSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFDGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRRLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 481 - protein, 481 aa, Homo sapiens
MGALARALPSILLALLLTSTPEALGANPGLVARITDKGLQYAAQEGLLALQSELLRITLPDFTGDLRIPHVGRGRYEFHSLNIHSCELLHSALRPVPGQGLSLSISDSSIRVQGRWKVRKSFFKLQGSFDVSVKGISISVNLLLGSESSGRPTVTASSCSSDIADVEVDMSGDLGWLLNLFHNQIESKFQKVLESRICEMIQKSVSSDLQPYLQTLPVTTEIDSFADIDYSLVEAPRATAQMLEVMFKGEIFHRNHRSPVTLLAAVMSLPEEHNKMVYFAISDYVFNTASLVYHEEGYLNFSITDDMIPPDSNIRLTTKSFRPFVPRLARLYPNMNLELQGSVPSAPLLNFSPGNLSVDPYMEIDAFVLLPSSSKEPVFRLSVATNVSATLTFNTSKITGFLKPGKVKVELKESKVGLFNAELLEALLNYYILNTFYPKFNDKLAEGFPLPLLKRVQLYDLGLQIHKDFLFLGANVQYMRV

SEQ ID NO: 482 - protein, 272 aa, Homo sapiens
MEACCLLQLPQRLLLLGAAALTATALETADLAELCGQTWQGDGLLLRSHAASRRFYFVAPDTDCGLWVQAAAPGDRIRFQFRFFLVYSLTPAPPALNTSSPAPADPCAPGSYLRFYEGPPGAPRPLGSPLCGLNIPVPVASSGPFLGLRLVTRGRQPRVDFVGEVTSFRLGPCGAYFRCQNGRCIPSSLVCDPWGMDNCGDGSDQGSWSPADCRGPSPVPSQTGSTDAHTSRSLTPSPALGSAGSLWIAAERSSPAGRDPTRQDAALEGSTE

SEQ ID NO: 483 - protein, 1097 aa, Homo sapiens
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENSVGLIIAILIPVAVAVIVGVVTSILCYRKREWIKETFYPDIPNPENCKALQFQKSVCEGSSALKTLEMNPCTPNNVEVLETRSAFPKIEDTEIISPVAERPEDRSDAEPENHVVVSYCPPIIEEEIPNPAADEAGGTAQVIYIDVQSMYQPQAKPEEEQENDPVGGAGYKPQMHLPINSTVEDIAAEEDLDKTAGYRPQANVNTWNLVSPDSPRSIDSNSEIVSFGSPCSINSRQFLIPPKDEDSPKSNGGGWSFTNFFQNKPND

SEQ ID NO: 484 - protein, 152 aa, Homo sapiens
  VARIANT (1)...(152): Xaa = Any Amino Acid
IMYIKYLSQCLVQMLASVTTLILASLILILFWGLQGSSLCCLLYFKPQKTMKFPNALQGRTNINNDSHTKCVQSSNIALMVLFIVQIIRLTHHVLSVSGRTWMGIEGSLKSYPLCKSVSVNFSLVSTDLFTLSGVSALSLKTFMIKTYLNAX

SEQ ID NO: 485 - protein, 344 aa, Homo sapiens
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEYVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 486 - protein, 1169 aa, Homo sapiens
MNYCRNPDAVAAPYCYTRDPGVRWEYCNLTQCSDAEGTAVAPPTVTPVPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTCQSWSSMTPHRHQRTPENYPNDGLTMNYCRNPDADTGPWCFTMDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLCASSSFDCGKPQVEPKKCPGSIVGGCVAHPHSWPWQVSLRTRFGKHFCGGTLISPEWVLTAAHCLKKSSRPSSYKVILGAHQEVNLESHVQEIEVSRLFLEPTQADIALLKLSRPAVITDKVMPACLPSPDYMVTARTECYITGWGETQGTFGTGLLKEAQLLVIENEVCNHYKYICAEHLARGTDSCQGDSGGPLVCFEKDKYILQGVTSWGLGCARPNKPGVYARVSRFVTWIEGMMRNN

SEQ ID NO: 487 - protein, 2040 aa, Homo sapiens
MEHKEVVLLLLLFLKSAAPEQSHVVQDCYHGDGQSYRGTYSTTVTGRTCQAWSSMTPHQHNRTTENYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDPVAAPYCYTRDPSVRWEYCNLTQCSDAEGTAVAPPTITPIPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTCQSWSSMTPHRHQRTPENYPNDGLTMNYCRNPDADTGPWCFTMDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLCASSSFDCGKPQVEPKKCPGSIVGGCVAHPHSWPWQVSLRTRFGKHFCGGTLISPEWVLTAAHCLKKSSRPSSYKVILGAHQEVNLESHVQEIEVSRLFLEPTQADIALLKLSRPAVITDKVMPACLPSPDYMVTARTECYITGWGETQGTFGTGLLKEAQLLVIENEVCNHYKYICAEHLARGTDSCQGDSGGPLVCFEKDKYILQGVTSWGLGCARPNKPGVYARVSRFVTWIEGMMRNN

SEQ ID NO: 488 - protein, 4544 aa, Homo sapiens
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEFACANSRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDCMDSSDEKSCEGVTHVCDPSVKFGCKDSARCISKAWVCDGDNDCEDNSDEENCESLACRPPSHPCANNTSVCLPPDKLCDGNDDCGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVILKSEPVHPFGLAVYGEHIFWTDWVRRAVQRANKHVGSNMKLLRVDIPQQPMGIIAVANDTNSCELSPCRINNGGCQDLCLLTHQGHVNCSCRGGRILQDDLTCRAVNSSCRAQDEFECANGECINFSLTCDGVPHCKDKSDEKPSYCNSRRCKKTFRQCSNGRCVSNMLWCNGADDCGDGSDEIPCNKTACGVGEFRCRDGTCIGNSSRCNQFVDCEDASDEMNCSATDCSSYFRLGVKGVLFQPCERTSLCYAPSWVCDGANDCGDYSDERDCPGVKRPRCPLNYFACPSGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECEYPTCGPSEFRCANGRCLSSRQWECDGENDCHDQSDEAPKNPHCTSPEHKCNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 489 - protein, 4655 aa, Homo sapiens
MDRGPAAVACTLLLALVACLAPASGQECDSAHFRCGSGHCIPADWRCDGTKDCSDDADEIGCAVVTCQQGYFKCQSEGQCIPSSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCTTHTCSSSEFQCASGRCIPQHWYCDQETDCFDASDEPASCGHSERTCLADEFKCDGGRCIPSEWICDGDNDCGDMSDEDKRHQCQNQNCSDSEFLCVNDRPPDRRCIPQSWVCDGDVDCTDGYDENQNCTRRTCSENEFTCGYGLCIPKIFRCDRHNDCGDYSDERGCLYQTCQQNQFTCQNGRCISKTFVCDEDNDCGDGSDELMHLCHTPEPTCPPHEFKCDNGRCIEMMKLCNHLDDCLDNSDEKGCGINECHDPSISGCDHNCTDTLTSFYCSCRPGYKLMSDKRTCVDIDECTEMPFVCSQKCENVIGSYICKCAPGYLREPDGKTCRQNSNIEPYLIFSNRYYLRNLTIDGYFYSLILEGLDNVVALDFDRVEKRLYWIDTQRQVIERMFLNKTNKETIINHRLPAAESLAVDWVSRKLYWLDARLDGLFVSDLNGGHRRMLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCEMRTCHPEYFQCTSGHCVHSELKCDGSADCLDASDEADCPTRFPDGAYCQATMFECKNHVCIPPYWKCDGDDDCGDGSDEELHLCLDVPCNSPNRFRCDNNRCIYSHEVCNGVDDCGDGTDETEEHCRKPTPKPCTEYEYKCGNGHCIPHDNVCDDADDCGDWSDELGCNKGKERTCAENICEQNCTQLNEGGFICSCTAGFETNVFDRTSCLDINECEQFGTCPQHCRNTKGSYECVCADGFTSMSDRPGKRCAAEGSSPLLLLPDNVRIRKYNLSSERFSEYLQDEEYIQAVDYDWDPKDIGLSVVYYTVRGEGSRFGAIKRAYIPNFESGRNNLVQEVDLKLKYVMQPDGIAVDWVGRHIYWSDVKNKRIEVAKLDGRYRKWLISTDLDQPAAIAVNPKLGLMFWTDWGKEPKIESAWMNGEDRNILVFEDLGWPTGLSIDYLNNDRIYWSDFKEDVIETIKYDGTDRRVIAKEAMNPYSLDIFEDQLYWISKEKGEVWKQNKFGQGKKEKTLVVNPWLTQVRIFHQLRYNKSVPNLCKQICSHLCLLRPGGYSCACPQGSSFIEGSTTECDAAIELPINLPPPCRCMHGGNCYFDETDLPKCKCPSGYTGKYCEMAFSKGISPGTTAVAVLLTILLIVVIGALAIAGFFHYRRTGSLLPALPKLPSLSSLVKPSENGNGVTFRSGADLNMDIGVSGFGPETAIDRSMAMSEDFVMEMGKQPIIFENPMYSARDSAVKVVQPIQVTVSENVDNKNYGSPINPSEIVPETNPTSPAADGTQVTKWNLFKRKSKQTTNFENPIYAQMENEQKESVAATPPPSPSLPAKPKPPSRRDPTPTYSATEDTFKDTANLVKEDSEV

SEQ ID NO: 490 - protein, 205 aa, Homo sapiens
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 491 - protein, 1647 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNMDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIELWNKHQEVKKQKALEKQRPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGRDKGSMWDQLEDAAMETFSISKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 492 - protein, 1588 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNMDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 493 - protein, 1565 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNMDRRQAEIGEGAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 494 - protein, 1545 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNMDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 495 - protein, 1608 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNMDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 496 - protein, 1479 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNMDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQFLKLKKW

SEQ ID NO: 497 - protein, 1581 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIELWNKHQEVKKQKALEKQRPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGRDKGSMWDQLEDAAMETFSISKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQFLKLKKW

SEQ ID NO: 498 - protein, 1588 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 499 - protein, 1455 aa, Homo sapiens
MSKSLKKKSHWTSKVHESVIGRNPEGQLGFELKGGAENGQFPYLGEVKPGKVAYESGSKLVSEELLLEVNETPVAGLTIRDVLAVIKHCKDPLRLKCVKQGGIVDKDLRHYLNLRFQKGSVDHELQQIIRDNLYLRTVPCTTRPHKEGEVPGVDYIFITVEDFMELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESRQQVPPRTSFRMDSSGPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTITVPHKIGRIIDGSPADRCAKLKVGDRILAVNGQSIINMPHADIVKLIKDAGLSVTLRIIPQEELNSPTSAPSSEKQSPMAQQSPLAQQSPLAQPSPATPNSPIAQPAPPQPLQLQGHENSYRSEVKARQDVKPDIRQPPFTDYRQPPLDYRQPPGGDYQQPPPLDYRQPPLLDYRQHSPDTRQYPLSDYRQPQDFDYFTVDMEKGAKGFGFSIRGGREYKMDLYVLRLAEDGPAIRNGRMRVGDQIIEINGESTRDMTHARAIELIKSGGRRVRLLLKRGTGQVPEYDEPAPWSSPAAAAPGLPEVGVSLDDGLAPFSPSHPAPPSDPSHQISPGPTWDIKREHDVRKPKELSACGQKKQRLGEQRERSASPQRAARPRLEEAPGGQGRPEAGRPASEARAPGLAAADAADAARAGGKEAPRAAAGSELCRREGPGAAPAFAGPGGGGSGALEAEGRAGARAGPRPGPRPPGGAPARKAAVAPGPWKVPGSDKLPSVLKPGASAASR

SEQ ID NO: 500 - protein, 1152 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 501 - protein, 99 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTEA

SEQ ID NO: 502 - protein, 395 aa, Homo sapiens
MNGQLNGFHEAFIEEGTFLFTSESVGEGHPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQGLMFGYATDETEECMPLTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRDLDLKKPIYQRTAAYGHFGRDSFPWEVPKKLKY

SEQ ID NO: 503 - protein, 175 aa, Homo sapiens
MAEVHVIGQIMGASGFSESSLFCKWGIHTGAAWKLLSGVREGQTQVDTPQIGDMAYWSHPIDLHFATKGLQGWPRLHFQVWSQDSFGRCQLAGYGFCHVPSSPGTHQLACPTWRPLGSWREQLARAFVGGGPQLLHGDTIYSGADRYRLHTAAGGTVHLEIGLLLRNFDRYGVEC

SEQ ID NO: 504 - protein, 3256 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGRKSGNLPSKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTANRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 505 - protein, 852 aa, Homo sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 506 - protein, 833 aa, Homo sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 507 - protein, 850 aa, Homo sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKNRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 508 - protein, 831 aa, Homo sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKNRRITHISAEQKRRFNIKLGFDTLHGLVSTLSAQPSLKERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 509 - protein, 247 aa, Homo sapiens
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGVAFLACYGLVLLVLLSPLTPLTVVTLLQASNVPAVVVGRLLQAATNYHNGHTGQLSAITVFLLFGGSLARIFTSIQETGDPLMAGTFVVSSLCNGLIAAQLLFYWNAKPPHKQKKAQ

SEQ ID NO: 510 - protein, 635 aa, Homo sapiens
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLCSSQAQMDYRRLQPSCLGTMPLSVCPPMAESGSCCTTHIANHSYLPLSYWQQP

SEQ ID NO: 511 - protein, 680 aa, Homo sapiens [sequence omitted]

SEQ ID NO: 512 - protein, 549 aa, Homo sapiens
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRYRPRQAGDWRWTRWSRRPVNRHSWFAL

SEQ ID NO: 513 - protein, 362 aa, Homo sapiens
MSENGSFANCCEAGGWAVRPGWSGAGSARPSRTPRPPWVAPALSAVLIVTTAVDVVGNLLVILSVLRNRKLRNAGNLFLVSLALADLVVAFYPYPLILVAIFYDGWALGEEHCKASAFVMGLSVIGSVFNITAIAINRYCYICHSMAYHRIYRRWHTPLHICLIWLLTVVALLPNFFVGSLEYDPRIYSCTFIQTASTQYTAAVVVIHFLLPIAVVSFCYLRIWVLVLQARRKAKPESRLCLKPSDLRSFLTMFVVFVIFAICWAPLNCIGLAVAINPQEMAPQIPEGLFVTSYLLAYFNSCLNAIVYGLLNQNFRREYKRILLALWNPRHCIQDASKGSHAEGLQSPAPPIIGVQHQADAL

SEQ ID NO: 514 - protein, 725 aa, Homo sapiens [sequence omitted]

SEQ ID NO: 515 - protein, 698 aa, Homo sapiens [sequence omitted]

SEQ ID NO: 516 - protein, 926 aa, Homo sapiens
MLKRLKGMRRDEKKSTAFQKKLEPAYQVSKGHKIRLTVELADHDAEVKWLKNGQEIQMSGRYIFESIGAKRTLTISQCSLADDAAYQCVVGGEKCSTELFVKEPPVLITRPLEDQLVMVGQRVEFECEVSEEGAQVKWLKDGVELTREETFKYRFKKDGQRHHLIINEAMLEDAGHYALCTSGGQALAELIVQEKKLEVYQSIADLMVGAKDQAVFKCEVSDENVRGVWLKNGKELVPDSRIKVSHIGRVHKLTIDDVTPADEADYSFVPEGFACNLSAKLHFMEVKIDFVPRQEPPKIHLDCPGRIPDTIVVVAGNKLRLDVPISGDPAPTVIWQKAITQGNKAPARPAPDAPEDTGDSDEWVFDKKLLCETEGRVRVETTKDRSIFTVEGAEKEDEGVYTVTVKNPVGEDQVNLTVKVIDVPDAPAAPKISNVGEDSCTVQWEPPAYDGGQPILGYILERKKKKSYRWMRLNFDLIQELSHEARRMIEGVVYEMRVYAVNAIGMSRPSPASQPFMPIGPPSEPTHLAVEDVSDTTVSLKWRPPERVGAGGLDGYSVEYCPEGCSEWVAALQGLTEHTSILVKDLPTGARLLFRVRAHNMAGPGAPVTTTEPVTVQEILQRPRLQLPRHLRQTIQKKVGEPVNLLIPFQGKPRPQVTWTKEGQPLAGEEVSIRNSPTDTILFIRAARRVHSGTYQVTVRIENMEDKATLVLQVVDKPSPPQDLRVTDAWGLNVALEWKPPQDVGNTELWGYTVQKADKKTMEWFTVLEHYRRTHCVVPELIIGNGYYFRVFSQNMVGFSDRAATTKEPVFIPRPGITYEPPNYKALDFSEAPSFTQPLVNRSVIAGYTAMLCCAVRGSPKPKISWFKNGLDLGEDARFRMFSKQGVLTLEIRKPCPFDGGIYVCRATNLQGEARCECRLEVRVPQ

SEQ ID NO: 517 - protein, 926 aa, Homo sapiens; identical to SEQ ID NO: 516

SEQ ID NO: 518 - protein, 1273 aa, Homo sapiens [sequence omitted]

SEQ ID NO: 519 - protein, 1464 aa, Homo sapiens
MSGMGENTSDPSRAETRKRKECPDQLGPSPKRNTEKRNREQENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARRVPMKERPVLPSSESFTTRQDLQGKITSLDTSTMRAAMKPGWEDLVRRCIQKFHAQHEGESVSYAKRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSTFNNPRPGQLGRLLPNQNLPLDITLQSPTGAGPFPPIRNSSPYSVIPQPGMMGNQGMIGNQGNLGNSSTGMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNRQPFGSSPDDLLCPHPAAESPSDEGALLDQLYLALRNFDGLEEIDRALGIPELVSQSQAVDPEQFSSQDSNIMLEQKAPVFPQQYASQAQMAQGSYSPMQDPNFHTMGQRPSYATLRMQPRPGLRPTGLVQNQPNQLRLQLQHRLQAQQNRQPLMNQISNVSNVNLTLRPGVPTQAPINAQMLAQRQREILNQHLRQRQMHQQQQVQQRTLMMRGQGLNMTPSMVAPSGMPATMSNPRIPQANAQQFPFPPNYGISQQPDPGFTGATTPQSPLMSPRMAHTQSPMMQQSQANPAYQAPSDINGWAQGNMGGNSMFSQQSPPHFGQQANTSMYSNNMNINVSMATNTGGMSSMNQMTGQISMTSVTSVPTSGLSSMGPEQVNDPALRGGNLFPNQLPGMDMIKQEGDTTRKYC

SEQ ID NO: 520 - protein, 1040 aa, Homo sapiens
MGEEGGSASHDEEERASVLLGHSPGCEMCSQEAFQAQRSQLVELLVSGSLEGFESVLDWLLSWEVLSWEDYEGFHLLGQPLSHLARRLLDTVWNKGTWACQKLIAAAQEAQADSQSPKLHGCWDPHSLHPARDLQSHRPAIVRRLHSHVENMLDLAWERGFVSQYECDEIRLPIFTPSQRARRLLDLATVKANGLAAFLLQHVQELPVPLALPLEAATCKKYMAKLRTTVSAQSRFLSTYDGAETLCLEDIYTENVLEVWADVGMAGPPQKSPATLGLEELFSTPGHLNDDADTVLVVGEAGSGKSTLLQRLHLLWAAGQDFQEFLFVFPFSCRQLQCMAKPLSVRTLLFEHCCWPDVGQEDIFQLLLDHPDRVLLTFDGFDEFKFRFTDRERHCSPTDPTSVQTLLFNLLQGNLLKNARKVVTSRPAAVSAFLRKYIRTEFNLKGFSEQGIELYLRKRHHEPGVADRLIRLLQETSALHGLCHLPVFSWMVSKCHQELLLQEGGSPKTTTDMYLLILQHFLLHATPPDSASQGLGPSLLRGRLPTLLHLGRLALWGLGMCCYVFSAQQLQAAQVSPDDISLGFLVRAKGVVPGSTAPLEFLHITFQCFFAAFYLALSADVPPALLRHLFNCGRPGNSPMARLLPTMCIQASEGKDSSVAALLQKAEPHNLQITAAFLAGLLSREHWGLLAECQTSEKALLRRQACARWCLARSLRKHFHSIPPAAPGEAKSVHAMPGFIWLIRSLYEMQEERLARKAARGLNVGHLKLTFCSVGPTECAALAFVLQHLRRPVALQLDYNSVGDIGVEQLLPCLGVCKALYLRDNNISDRGICKLIECALHCEQLQKLALFNNKLTDGCAHSMAKLLACRQNFLALRLGNNYITAAGAQVLAEGLRGNTSLQFLGFWGNRVGDEGAQALAEALGDHQSLRWLSLVGNNIGSVGAQALALMLAKNVMLEELCLEENHLQDEGVCSLAEGLKKNSSLKILKLSNNCITYLGAEALLQALERNDTILEVWLRGNTFSLEEVDKLGCRDTRLLL

SEQ ID NO: 521 - protein, 1203 aa, Homo sapiens
MGNLKSVAQEPGPPCGLGLGLGLGLCGKQGPATPAPEPSRAPASLLPPAPEHSPPSSPLTQPPEGPKFPRVKNWEVGSITYDTLSAQAQQDGPCTPRRCLGSLVFPRKLQGRPSPGPPAPEQLLSQARDFINQYYSSIKRSGSQAHEQRLQEVEAEVAATGTYQLRESELVFGAKQAWRNAPRCVGRIQWGKLQVFDARDCRSAQEMFTYICNHIKYATNRGNLRSAITVFPQRCPGRGDFRIWNSQLVRYAGYRQQDGSVRGDPANVEITELCIQHGWTPGNGRFDVLPLLLQAPDDPPELFLLPPELVLEVPLEHPTLEWFAALGLRWYALPAVSNMLLEIGGLEFPAAPFSGWYMSTEIGTRNLCDPHRYNILEDVAVCMDLDTRTTSSLWKDKAAVEINVAVLHSYQLAKVTIVDHHAATASFMKHLENEQKARGGCPADWAWIVPPISGSLTPVFHQEMVNYFLSPAFRYQPDPWKGSAAKGTGITRKKTFKEVANAVKISASLMGTVMAKRVKATILYGSETGRAQSYAQQLGRLFRKAFDPRVLCMDEYDVVSLEHETLVLVVTSTFGNGDPPENGESFAAALMEMSGPYNSSPRPEQHKSYKIRFNSISCSDPLVSSWRRKRKESSNTDSAGALGTLRFCVFGLGSRAYPHFCAFARAVDTRLEELGGERLLQLGQGDELCGQEEAFRGWAQAAFQAACETFCVGEDAKAAARDIFSPKRSWKRQRYRLSAQAEGLQLLPGLIHVHRRKMFQATIRSVENLQSSKSTRATILVRLDTGGQEGLQYQPGDHIGVCPPNRPGLVEALLSRVEDPPAPTEPVAVEQLEKGSPGGPPPGWVRDPRLPPCTLRQALTFFLDITSPPSPQLLRLLSTLAEEPREQQELEALSQDPRRYEEWKWFRCPTLLEVLEQFPSVALPAPLLLTQLPLLQPRYYSVSSAPSTHPGEIHLTVAVLAYRTQDGLGPLHYGVCSTWLSQLKPGDPVPCFIRGAPSFRLPPDPSLPCILVGPGTGIAPFRGFWQERLHDIESKGLQPTPMTLVFGCRCSQLDHLYRDEVQNAQQRGVFGRVLTAFSREPDNPKTYVQDILRTELAAEVHRVLCLERGHMFVCGDVTMATNVLQTVQRILATEGDMELDEAGDVIGVLRDQQRYHEDIFGLTLRTQEVTSRIRTQSFSLQERQLRGAVPWAFDPPGSDTNSP

SEQ ID NO: 522 - protein, 1278 aa, Homo sapiens
MTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 523 - protein, 279 aa, Homo sapiens
MKIIILLGFLGATLSAPLIPQRLMSASNSNELLLNLNNGQLLPLQLQGPLNSWIPPFSGILQQQQQAQIPGLSQFSLSALDQFAGLLPNQIPLTGEASFAQGAQAGQVDPLQLQTPPQTQPGPSHVMPYVFSFKMPQEQGQMFQYYPVYMVLPWEQPQQTVPRSPQQTRQQQYEEQIPFYAQFGYIPQLAEPAISGGQQQLAFDPQLGTAPEIAVMSTGEEIPYLQKEAINFRHDSAGVFMPSTSPKPSTTNVFTSAVDQTITPELPEEKDKTDSLREP

SEQ ID NO: 524 - protein, 307 aa, Homo sapiens
MNHSVVTEFIILGLTKKPELQGIIFLFFLIVYLVAFLGNMLIIIAKIYNNTLHTPMYVFLLTLAVVDIICTTSIIPKMLGTMLTSENTISYAGCMSQLFLFTWSLGAEMVLFTTMAYDRYVAICFPLHYSTIMNHHMCVALLSMVMAIAVTNSWVHTALIMRLTFCGPNTIDHFFCEIPPLLALSCSPVRINEVMVYVADITLAIGDFILTCISYGFIIVAILRIRTVEGKRKAFSTCSSHLTVVTLYYSPVIYTYIRPASSYTFERDKVVAALYTLVTPTLNPMVYSFQNREMQAGIRKVFAFLKH

SEQ ID NO: 525 - protein, 316 aa, Homo sapiens
MVNQSSPMGFLLLGFSEHPALERTLFVVVFTSYLLTLVGNTLIILLSVLYPRLHSPMYFFLSDLSFLDLCFTTSCVPQMLVNLWGPKKTISFLGCSVQLFIFLSLGTTECILLTVMAFDRYVAVCQPLHYATIIHPRLCWQLASVAWVMSLVQSIVQTPSTLHLPFCPHQQIDDFLCEVPSLIRLSCGDTSYNEIQLAVSSVIFVVVPLSLILASYGATAQAVLRINSATAWRKAFGTCSSHLTVVTLFYSSVIAVYLQPKNPYAQGRGKFFGLFYAVGTPSLNPLVYTLRNKEIKRALRRLLGKERDSRESWRAA

SEQ ID NO: 526 - protein, 304 aa, Homo sapiens
MVFLSSVETDQRKMSAGNHSSVTEFILAGLSEQPELQLRLFLLFLGIYVVTVVGNLSMITLIGLSSHLHTPMYYFLSGLSFIDICHSTIITPKMLVNFVTEKNIISYPECMTQLYFFLIFAIAECHMLAVTAYDRYVAICSPLLYNVIMSYHHCFWLTVGVYILGILGSTIHTGFMLRLFLCKTNVINHYFCDLFPLLGLSCSSTYINELLVLVLSAFNILTPALTILASYIFIIASILRIRSTEGRSKAFSTCSSHILAVAVFFGSAAFMYLQPSSVSSMDQGKVSSVFYTIVVPMLNPQSIA

SEQ ID NO: 527 - protein, 423 aa, Homo sapiens
MLCHRGGQLIVPIIPLCPEHSCRGRRLQNLLSGPWPKQPMELHNLSSPSPSLSSSVLPPSFSPSPSSAPSAFTTVGGSSGGPCHPTSSSLVSAFLAPILALEFVLGLVGNSLALFIFCIHTRPWTSNTVFLVSLVAADFLLISNLPLRVDYYLLHETWRFGAAACKVNLFMLSTNRTASVVFLTAIALNRYLKVVQPHHVLSRASVGAAARVAGGLWVGILLLNGHLLLSTFSGPSCLSYRVGTKPSASLRWHQALYLLEFFLPLALILFAIVSIGLTIRNRGLGGQAGPQRAMRVLAMVVAVYTICFLPSIIFGMASMVAFWLSACRSLDLCTQLFHGSLAFTYLNSVLDPVLYCFSSPNFLHQSRALLGLTRGRQGPVSDESSYQPSRQWRYREASRKAEAIGKLKVQGEVSLEKEGSSQG

SEQ ID NO: 528 - protein, 431 aa, Homo sapiens
MGSPGATTGWGLLDYKTEKYVMTRNWRVGALQRLLQFGIVVYVVGWALLAKKGYQERDLEPQFSIITKLKGVSVTQIKELGNRLWDVADFVKPPQGENVFFLVTNFLVTPAQVQGRCPEHPSVPLANCWVDEDCPEGEGGTHSHGVKTGQCVVFNGTHRTCEIWSWCPVESGVVPSRPLLAQAQNFTLFIKNTVTFSKFNFSKSNALETWDPTYFKHCRYEPQFSPYCPVFRIGDLVAKAGGTFEDLALLGGSVGIRVHWDCDLDTGDSGCWPHYSFQLQEKSYNFRTATHWWEQPGVEARTLLKLYGIRFDILVTGQAGKFGLIPTAVTLGTGAAWLGVVTFFCDLLLLYVDREAHFYWRTKYEEAKAPKATANSVWRELALASQARLAECLRRSSAPAPTATAAGSQTQTPGWPCPSSDTHLPTHSGSL

SEQ ID NO: 529 - protein, 1627 aa, Homo sapiens
MRLWSWVLHLGLLSAALGCGLAERPRRARRDPRAGRPPRPAAGPATCATRAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTISYPYSQLAQTTFWLRAYFSQPMVAAAVIVHLVTDGTYYGDQKQETISVQLLDTKDQSHDLGLHVLSCRNNPLIIPVVHDLSQPFYHSQAVRVSFSSPLVAISGVALRSFDNFDPVTLSSCQRGETYSPAEQSCVHFACEKTDCPELAVENASLNCSSSDRYHGAQCTVSCRTGYVLQIRRDDELIKSQTGPSVTVTCTEGKWNKQVACEPVDCSIPDHHQVYAASFSCPEGTTFGSQCSFQCRHPAQLKGNNSLLTCMEDGLWSFPEALCELMCLAPPPVPNADLQTARCRENKHKVGSFCKYKCKPGYHVPGSSRKSKKRAFKTQCTQDGSWQEGACVPVTCDPPPPKFHGLYQCTNGFQFNSECRIKCEDSDASQGLGSNVIHCRKDGTWNGSFHVCQEMQGQCSVPNELNSNLKLQCPDGYAIGSECATSCLDHNSESIILPMNVTVRDIPHWLNPTRVERVVCTAGLKWYPHPALIHCVKGCEPFMGDNYCDAINNRAFCNYDGGDCCTSTVKTKKVTPFPMSCDLQGDCACRDPQAQEHSRKDLRGYSHG

SEQ ID NO: 530 - protein, 199 aa, Homo sapiens
MTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIVALLYEEPFTAEIYRQKASGSHKRS

SEQ ID NO: 531 - protein, 236 aa, Homo sapiens
MKRSGNPGAEVTNSSVAGPDCCGGLGNIDFRQADFCVMTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIVALLYEEPFTAEIYRQKASGSHKRS

SEQ ID NO: 532 - protein, 199 aa, Homo sapiens; identical to SEQ ID NO: 530

SEQ ID NO: 533 - protein, 634 aa, Homo sapiens
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSMAAPWETGDTFPDVVAIAPDVRATSSPGLRDGSPDVTTADIGANTPDATKGCPDVQASLPDAKAKSPPTMVDSLLAVTLAGNLGLTFLRGSQTQSHPDLGTEGCWDQLSAPRTFTLLDPKASLLTMAFLNGALDGVILGDYLSRTPEPRPSLSHLLSQYYGAGVARDPGFRSNFRRQNGAALTSASILAQQVWGTLVLLQRLEPVHLQLQCMSQEQLAQVAANATKEFTEAFLGCPAIHPRCRWGAAPYRGRPKLLQLPLGFLYVHHTYVPAPPCTDFTRCAANMRSMQRYHQDTQGWGDIGYGFVVGSDGYVYEGRGWHWVGAHTLGHNSRGFGVAIVGNYTAALPTEAALRTVRDTLPSCAVRAGLLRPDYALLGHRQLVRTDCPGDALFDLLRTWPHFTAVSLRSLHYTARRPSVYTSSTRPLPPACNSCARTASARPPTSRRHVYSGNLGPAFAGHSAGNIPDPVTSAYAASAQPQTQPACPFPSS

SEQ ID NO: 534 - protein, 477 aa, Homo sapiens
MGRTVVVLGGGISGLAASYHLSRAPCPPKVVLVESSERLGGWIRSVRGPNGAIFELGPRGIRPAGALGARTLLLVSELGLDSEVLPVRGDHPAAQNRFLYVGGALHALPTGLRGLLRPSPPFSKPLFWAGLRELTKPRGKEPDETVHSFAQRRLGPEVASLAMDSLCRGVFAGNSRELSIRSCFPSLFQAEQTHRSILLGLLLGAGRTPQPDSALIRQALAERWSQWSLRGGLEMLPQALETHLTSRGVSVLRGQPVCGLSLQAEGRWKVSLRDSSLEADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 535 - protein, 306 aa, Homo sapiens
MASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 536 - protein, 706 aa, Homo sapiens
MSPFLRIGLSNFDCGSCQSCQGEAVNPYCAVLVKEYVESENGQMYIQKKPTMYPPWDSTFDAHINKGRVMQIIVKGKNVDLISETTVELYSLAERCRKNNGKTEIWLELKPQGRMLMNARYFLEMSDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKLFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 537 - protein, 1174 aa, Homo sapiens
MPLPFGLKLKRTRRYTVSSKSCLVARIQLLNNEFVEFTLSVESTGQESLEAVAQRLELREVTYFSLWYYNKQNQRRWVDLEKPLKKQLDKYALEPTVYFGVVFYVPSVSQLQQEITRYQYYLQLKKDILEGSIPCTLEQAIQLAGLAVQADFGDFDQYESQDFLQKFALFPVGWLQDEKVLEEATQKVALLHQKYRGLTAPDAEMLYMQEVERMDGYGEESYPAKDSQGSDISIGACLEGIFVKHKNGRHPVVFRWHDIANMSHNKSFFALELANKEETIQFQTEDMETAKYIWRLCVARHKFYRLNQCNLQTQTVTVNPIRRRSSSRMSLPKPQPYVMPPPPQLHYNGHYTEPYASSQDNLFVPNQNGYYCHSQTSLDRAQIDFNGRIRNGSVYSAHSTNSLNNPQPYLQPSPMSSNPSITGSDVMRPDYLPSHRHSAVIPPSYRPTPDYETVMKQLNRGLVHAERQSHSLRNLNIGSSYAYSRPAALVYSQPEIREHAQLPSPAAAHCPFSLSYSFHSPSPYPYPAERRPVVGAVSVPELTNAQLQAQDYPSPNIMRTQVYRPPPPYPPPRPANSTPDLSRHLYISSSNPDLITRRVHHSVQTFQEDSLPVAHSLQEVSEPLTAARHAQLHKRNSIEVAGLSHGLEGLRLKERTLSASAAEVAPRAVSVGSQPSVFTERTQREGPEEAEGLRYGHKKSLSDATMLIHSSEEEEDEDFEEESGARAPPARAREPRPGLAQDPPGCPRVLLAGPLHILEPKAHVPDAEKRMMDSSPVRTTAEAQRPWRDGLLMPSMSESDLTTSGRYRARRDSLKKRPVSDLLSGKKNIVEGLPPLGGMKKTRVDAKKIGPLKLAALNGLSLSRVPLPDEGKEVATRATNDERCKILEQRLEQGMVFTEYERILKKRLVDGECSTARLPENAERNRFQDVLPYDDARVELVPTKENNTGYINASHIKVSVSGIEWDYIATQGPLQNTCQDFWQMVWEQGIAIIAMVTAEEEGGREKSFRYWPRLGSRHNTVTYGRFKITTRFRTDSGCYATTGLKMKHLLTGQERTVWHLQYTDWPEHGCPEDLKGFLSYLEEIQSVRRHTNSTSDPQSPNPPLLVHCSAGVGRTGVVILSEIMIACLEHNEVLDIPRVLDMLRQQRMMLVQTLCQYTFVYRVLIQFLKSSRLI

SEQ ID NO: 538 - protein, 1566 aa, Homo sapiens
MTADKDKDKDKEKDRDRDRDREREKRDKARESENSRPRRSCTLEGGAKNYAESDHSEDEDNDNNSATAEESTKKNKKKPPKKKSRYERTDTGEITSYITEDDVVYRPGDCVYIESRRPNTPYFICSIQDFKLVHNSQACCRSPTPALCDPPACSLPVASQPPQHLSEAGRGPVGSKRDHLLMNVKWYYRQSEVPDSVYQHLVQDRHNENDSGRELVITDPVIKNRELFISDYVDTYHAAALRGKCNISHFSDIFAAREFKARVDSFFYILGYNPETRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 539 - protein, 1012 aa, Homo sapiens
MFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 540 - protein, 1566 aa, Homo sapiens; identical to SEQ ID NO: 538

SEQ ID NO: 541 - protein, 664 aa, Homo sapiens
MAAVGPPQQQVRMAHQQVWAALEVALRVPCLYIIDAIFNSYPDSSQSRFCIVLQIFLRLFGVFASSIVLILSQRSLFKFYTYSSAFLLAATSVLVNYYASLHIDFYGAYNTSAFGIELLPRKGPSLWMALIVLQLTFGIGYVTLLQIHSIYSQLIILDLLVPVIGLITELPLHIRETLLFTSSLILTLNTVFVLAVKLKWFYYSTRYVYLLVRHMYRIYGLQLLMEDTWKRIRFPDILRVFWLTRVTAQATVLMYILRMANETDSFFISWDDFWDLICNLIISGCDSTLTVLGMSAVISSVAHYLGLGILAFIGSTEEDDRRLGFVAPVLFFILALQTGLSGLRPEERLIRLSRNMCLLLTAVLHFIHGMTDPVLMSLSASHVSSFRRHFPVLFVSACLFILPVLLSYVLWHHYALNTWLFAVTAFCVELCLKVIVSLTVYTLFMIDGYYNVLWEKLDDYVYYVRSTGSIIEFIFGVVMFGNGAYTMMFESGSKIRAFMMCLHAYFNIYLQAKNGWKTFMNRRTAVKKINSLPEIKGSRLQEINDVCAICYHEFTTSARITPCNHYFHALCLRKWLYIQDTCPMCHQKVYIEDDIKDNSNVSNNNGFIPPNETPEEAVREAAAESDRELNEDDSTDCDDDVQRERNGVIQHTGAAAEEFNDDTD

SEQ ID NO: 542 - protein, 192 aa, Homo sapiens
MAEQQGRELEAECPVCWNPFNNTFHTPKMLDCCHSFCVECLAHLSLVTPARRRLLCPLCRQPTVLASGQPVTDLPTDTAMLALLRLEPHHVILEGHQLCLKDQPKSRYFLRQPQVYTLDLGPQPGGQTGPPPDTASATVSTPILIPSHHSLRECFRNPQFRIFAYLMAVILSVTLLLIFSIFWTKQFLWGVG

SEQ ID NO: 543 - protein, 2347 aa, Homo sapiens
MKNIYCLIPKLVNFATLGCLWISVVQCTVLNSCLKSCVTNLGQQLDLGTPHNLSEPCIQGCHFWNSVDQKNCALKCRESCEVGCSSAEGAYEEEVLENADLPTAPFASSIGSHNMTLRWKSANFSGVKYIIQWKYAQLLGSWTYTKTVSRPSYVVKPLHPFTEYIFRVVWIFTAQLQLYSPPSPSYRTHPHGVPETAPLIRNIESSSPDTVEVSWDPPQFPGGPILGYNLRLISKNQKLDAGTQRTSFQFYSTLPNTIYRFSIAAVNEVGEGPEAESSITTSSSAVQQEEQWLFLSRKTSLRKRSLKHLVDEAHCLRLDAIYHNITGISVDVHQQIVYFSEGTLIWAKKAANMSDVSDLRIFYRGSGLISSISIDWLYQRMYFIMDELVCVCDLENCSNIEEITPPSISAPQKIVADSYNGYVFYLLRDGIYRADLPVPSGRCAEAVRIVESCTLKDFAIKPQAKRIIYFNDTAQVFMSTFLDGSASHLILPRIPFADVKSFACENNDFLVTDGKVIFQQDALSFNEFIVGCDLSHIEEFGFGNLVIFGSSSQLHPLPGRPQELSVLFGSHQALVQWKPPALAIGANVILISDIIELFELGPSAWQNWTYEVKVSTQDPPEVTHIFLNISGTMLNVPELQSAMKYKVSVRASSPKRPGPWSEPSVGTTLVPASEPPFIMAVKEDGLWSKPLNSFGPGEFLSSDIGNVSDMDWYNNSLYYSDTKGDVFVWLLNGTDISENYHLPSIAGAGALAFEWLGHFLYWAGKTYVIQRQSVLTGHTDIVTHVKLLVNDMVVDSVGGYLYWTTLYSVESTRLNGESSLVLQTQPWFSGKKVIALTLDLSDGLLYWLVQDSQCIHLYTAVLRGQSTGDTTITEFAAWSTSEISQNALMYYSGRLFWINGFRIITTQEIGQKTSVSVLEPARFNQFTIIQTSLKPLPGNFSFTPKVIPDSVQESSFRIEGNASSFQILWNGPPAVDWGVVFYSVEFSAHSKFLASEQHSLPVFTVEGLEPYALFNLSVTPYTYWGKGPKTSLSLRAPETVPSAPENPRIFILPSGKCCNKNEVVVEFRWNKPKHENGVLTKFEIFYNISNQSITNKTCEDWIAVNVTPSVMSFQLEGMSPRCFIAFQVRAFTSKGPGPYADVVKSTTSEINPFPHLITLLGNKIVFLDMDQNQVVWTFSAERVISAVCYTADNEMGYYAEGDSLFLLHLHNRSSSELFQDSLVFDITVITIDWISRHLYFALKESQNGMQVFDVDLEHKVKYPREVKIHNRNSTIISFSVYPLLSRLYWTEVSNFGYQMFYYSIISHTLHRILQPTATNQQNKRNQCSCNVTEFELSGAMAIDTSNLEKPLIYFAKAQEIWAMDLEGCQCWRVITVPAMLAGKTLVSLTVDGDLIYWIITAKDSTQIYQAKKGNGAIVSQVKALRSRHILAYSSVMQPFPDKAFLSLASDTVEPTILNATNTSLTIRLPLAKTNLTWYGITSPTPTYLVYYAEVNDRKNSSDLKYRILEFQDSIALIEDLQPFSTYMIQIAVKNYYSDPLEHLPPGKEIWGKTKNGVPEAVQLINTTVRSDTSLIISWRESHKPNGPKESVRYQLAISHLALIPETPLRQSEFPNGRLTLLVTRLSGGNIYVLKVLACHSEEMWCTESHPVTVEMFNTPEKPYSLVPENTSLQFNWKAPLNVNLIRFWVELQKWKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRKSTSNNLQNQNLRWKMTFNGSCSSVCTWKSKNLKGIFQFRVVAANNLGFGEYSGISENIILVGDDFWIPETSFILTIIVGIFLVVTIPLTFVWHRRLKNQKSAKEGVTVLINEDKELAELRGLAAGVGLANACYAIHTLPTQEEIENLPAFPREKLTLRLLLGSGAFGEVYEGTAVDILGVGSGEIKVAVKTLKKGSTDQEKIEFLKEAHLMSKFNHPNILKQLGVCLLNEPQYIILELMEGGDLLTYLRKARMATFYGPLLTLVDLVDLCVDISKGCVYLERMHFIHRDLAARNCLVSVKDYTSPRIVKIGDFGLARDIYKNDYYRKRGEGLLPVRWMAPESLMDGIFTTQSDVWSFGILIWEILTLGHQPYPAHSNLDVLNYVQTGGRLEPPRNCPDDLWNLMTQCWAQEPDQRPTFHRIQDQLQLFRNFFLNSIYKSRDEANNSGVINESFEGEDGDVICLNSDDIMPVALMETKNREGLNYMVLATECGQGEEKSEGPLGSQESESCGLRKEEKEPHADKDFCQEKQVAYCPSGKPEGLNYACLTHSGYGDGSD

SEQ ID NO: 544 - protein, 669 aa, Homo sapiens
MEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 545 - protein, 418 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 546 - protein, 418 aa, Homo sapiens; identical to SEQ ID NO: 545

SEQ ID NO: 547 - protein, 418 aa, Homo sapiens; identical to SEQ ID NO: 545

SEQ ID NO: 548 - protein, 405 aa, Homo sapiens
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGKIVDLFSGLDSPAILVLVNYIFFKGTWTQPFDLASTREENFYVDETTVVKVPMMLQSSTISYLHDAELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 549 - protein, 335 aa, Homo sapiens
MQGQGRRRGTCKDIFCSKMASYLYGVLFAVGLCAPIYCVSPANAPSAYPRPSSTKSTPASQVYSLNTDFAFRLYRRLVLETPSQNIFFSPARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 550 - protein, 435 aa, Homo sapiens
MQGQGRRRGTCKDIFCSKMASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 551 - protein, 1709 aa, Homo sapiens
MGFLPKLLLLASFFPAGQASWGVSSPQDVQGVKGSCLLIPCIFSFPADVEVPDGITAIWYYDYSGQRQVVSHSADPKLVEARFRGRTEFMGNPEHRVCNLLLKDLQPEDSGSYNFRFEISEVNRWSDVKGTLVTVTEEPRVPTIASPVELLEGTEVDFNCSTPYVCLQEQVRLQWQGQDPARSVTFNSQKFEPTGVGHLETLHMAMSWQDHGRILRCQLSVANHRAQSEIHLQVKYAPKGVKILLSPSGRNILPGELVTLTCQVNSSYPAVSSIKWLKDGVRLQTKTGVLHLPQAAWSDAGVYTCQAENGVGSLVSPPISLHIFMAEVQVSPAGPILENQTVTLVCNTPNEAPSDLRYSWYKNHVLLEDAHSHTLRLHLATRADTGFYFCEVQNVHGSERSGPVSVVVNHPPLTPVLTAFLETQAGLVGILHCSVVSEPLATLVLSHGGHILASTSGDSDHSPRFSGTSGPNSLRLEIRDLEETDSGEYKCSATNSLGNATSTLDFHANAARLLISPAAEVVEGQAVTLSCRSGLSPTPDARFSWYLNGALLHEGPGSSLLLPAASSTDAGSYHCRARDGHSASGPSSPAVLTVLYPPRQPTFTTRLDLDAAGAGAGRRGLLLCRVDSDPPARLQLLHKDRVVATSLPSGGGCSTCGGCSPRMKVTKAPNLLRVEIHNPLLEEEGLYLCEASNALGNASTSATFNGQATVLAIAPSHTLQEGTEANLTCNVSREAAGSPANFSWFRNGVLWAQGPLETVTLLPVARTDAALYACRILTEAGAQLSTPVLLSVLYPPDRPKLSALLDMGQGHMALFICTVDSRPLALLALFHGEHLLATSLGPQVPSHGRFQAKAEANSLKLEVRELGLGDSGSYRCEATNVLGSSNTSLFFQVRGAWVQVSPSPELQEGQAVVLSCQVHTGVPEGTSYRWYRDGQPLQESTSATLRFAAITLTQAGAYHCQAQAPGSATTSLAAPISLHVSYAPRHVTLTTLMDTGPGRLGLLLCRVDSDPPAQLRLLHGDRLVASTLQGVGGPEGSSPRLHVAVAPNTLRLEIHGAMLEDEGVYICEASNTLGQASASADFDAQAVNVQVWPGATVREGQLVNLTCLVWTTHPAQLTYTWYQDGQQRLDAHSIPLPNVTVRDATSYRCGVGPPGRAPRLSRPITLDVLYAPRNLRLTYLLESHGGQLALVLCTVDSRPPAQLALSHAGRLLASSTAASVPNTLRLELRGPQPRDEGFYSCSARSPLGQANTSLELRLEGVRVILAPEAAVPEGAPITVTCADPAAHAPTLYTWYHNGRWLQEGPAASLSFLVATRAHAGAYSCQAQDAQGTRSSRPAALQVLYAPQDAVLSSFRDSRARSMAVIQCTVDSEPPAELALSHDGKVLATSSGVHSLASGTGHVQVARNALRLQVQDVPAGDDTYVCTAQNLLGSISTIGRLQVEGARVVAEPGLDVPEGAALNLSCRLLGGPGPVGNSTFAWFWNDRRLHAEPVPTLAFTHVARAQAGMYHCLAELPTGAAASAPVMLRVLYPPKTPTMMVFVEPEGGLRGILDCRVDSEPLASLTLHLGSRLVASSQPQGAPAEPHIHVLASPNALRVDIEALRPSDQGEYICSASNVLGSASTSTYFGVRALHRLHQFQQLLWVLGLLVGLLLLLLGLGACYTWRRRRVCKQSMGENSVEMAFQKETTQLIDPDAATCETSTCAPPLG

SEQ ID NO: 552 - protein, 348 aa, Homo sapiens
MNDPNSCVDNATVCSGASCVVPESNFNNILSVVLSTVLTILLALVMFSMGCNVEIKKFLGHIKRPWGICVGFLCQFGIMPLTGFILSVAFDILPLQAVVVLIIGCCPGGTASNILAYWVDGDMDLSVSMTTCSTLLALGMMPLCLLIYTKMWVDSGSIVIPYDNIGTSLVALVVPVSIGMFVNHKWPQKAKIILKIGSIAGAILIVLIAVVGGILYQSAWIIAPKLWIIGTIFPVAGYSLGFLLARIAGLPWYRCRTVAFETGMQNTQLCSTIVQLSFTPEELNVVFTFPLIYSIFQLAFAAIFLGFYVAYKKCHGKNKAEIPESKENGTEPESSFYKANGGFQPDEK

SEQ ID NO: 553 - protein, 706 aa, Homo sapiens [sequence omitted]

SEQ ID NO: 554 - protein, 312 aa, Homo sapiens [sequence omitted]

SEQ ID NO: 555 - protein, 166 aa, Homo sapiens
MRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRGKRYLKGTSVGLF

SEQ ID NO: 556 - protein, 525 aa, Homo sapiens [sequence omitted]

SEQ ID NO: 557 - protein, 493 aa, Homo sapiens [sequence omitted]

SEQ ID NO: 558 - protein, 551 aa, Homo sapiens
MRDYDEVIAFLGEWGPFQRLIFFLLSASIIPNGFNGMSVVFLAGTPEHRCRVPDAANLSSAWRNNSVPLRLRDGREVPHSCSRYRLATIANFSALGLEPGRDVDLGQLEQESCLDGWEFSQDVYLSTVVTEWNLVCEDNWKVPLTTSLFFVGVLLGSFVSGQLSDRFGRKNVLFATMAVQTGFSFLQIFSISWEMFTVLFVIVGMGQISNYVVAFILGTEILGKSVRIIFSTLGVCTFFAVGYMLLPLFAYFIRDWRMLLLALTVPGVLCVPLWWFIPESPRWLISQRRFREAEDIIQKAAKMNNIAVPAVIFDSVEELNPLKQQKAFILDLFRTRNIAIMTIMSLLLWMLTSVGYFALSLDAPNLHGDAYLNCFLSALIEIPAYITAWLLLRTLPRRYIIAAVLFWGGGVLLFIQLVPVDYYFLSIGLVMLGKFGITSAFSMLYVFTAELYPTLVRNMAVGVTSTASRVGSIIAPYFVYLGAYNRMLPYIVMGSLTVLIGILTLFFPESLGMTLPETLEQMQKVKWFRSGKKTRDSMETEENPKVLITAF

SEQ ID NO: 559 - protein, 557 aa, Homo sapiens
MRDYDEVTAFLGEWGPFQRLIFFLLSASIIPNGFTGLSSVFLIATPEHRCRVPDAANLSSAWRNHTVPLRLRDGREVPHSCRRYRLATIANFSALGLEPGRDVDLGQLEQESCLDGWEFSQDVYLSTIVTEWNLVCEDDWKAPLTISLFFVGVLLGSFISGQLSDRFGRKNVLFVTMGMQTGFSFLQIFSKNFEMFVVLFVLVGMGQISNYVAAFVLGTEILGKSVRIIFSTLGVCIFYAFGYMVLPLFAYFIRDWRMLLVALTMPGVLCVALWWFIPESPRWLISQGRFEEAEVIIRKAAKANGIVVPSTIFDPSELQDLSSKKQQSHNILDLLRTWNIRMVTIMSIMLWMTISVGYFGLSLDTPNLHGDIFVNCFLSAMVEVPAYVLAWLLLQYLPRRYSMATALFLGGSVLLFMQLVPPDLYYLATVLVMVGKFGVTAAFSMVYVYTAELYPTVVRNMGVGVSSTASRLGSILSPYFVYLGAYDRFLPYILMGSLTILTAILTLFLPESFGTPLPDTIDQMLRVKGMKHRKTPSHTRMLKDGQERPTILKSTAF

SEQ ID NO: 560 - protein, 748 aa, Homo sapiens
MIPAASSTPPGDALFPSVAPQDFWRSQVTGYSGSVTRHLSHRANNFKRHPKRRKCIRPSPPPPPNTPCPLELVDFGDLHPQRSFRELLFNGCILFGIEFSYAMETAYVTPVLLQMGLPDQLYSLVWFISPILGFLLQPLLGAWSDRCTSRFGRRRPFILVLAIGALLGLSLLLNGRDIGIALADVTGNHKWGLLLTVCGVVLMDFSADSADNPSHAYMMDVCSPADQDRGLNIHALLAGLGGGFGYVVGGIHWDKTGFGRALGGQLRVIYLFTAVTLSVTTVLTLVSIPERPLRPPSEKRAAMKSPSLPLPPSPPVLPEEGPGDSLPSHTATNFSSPISPPSPLTPKYGSFISRDSSLTGISEFASSFGTANIDSVLIDCFTGGHDSYLAIPGSVPRPPISVSFPRAPDGFYRQDRGLLEGREGALTSGCDGDILRVGSLDTSKPRSSGILKRPQTLAIPDAAGGGGPETSRRRNVTFSQQVANILLNGVKYESELTGSSERAEQPLSVGRLCSTICNMPKALRTLCVNHFLGWLSFEGMLLFYTDFMGEVVFQGDPKAPHTSEAYQKYNSGVTMGCWGMCIYAFSAAFYSAILEKLEEFLSVRTLYFIAYLAFGLGTGLATLSRNLYVVLSLCITYGILFSTLCTLPYSLLCDYYQSKKFAGSSADGTRRGMGVDISLLSCQYFLAQILVSLVLGPLTSAVGSANGVMYFSSLVSFLGCLYSSLFVIYEIPPSDAADEEHRPLLLNV

SEQ ID NO: 561 - protein, 579 aa, Homo sapiens
MFLTKNCKQEQERVESAKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFGKNSYFFPHPIRTILLLLFFITL

SEQ ID NO: 562 - protein, 670 aa, Homo sapiens
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFAGIPAPIYFGALMDSTCLHWGTLKCGESGACRIYDSTTFRYIYLGLPAALRGSSFVPALIILILLRKCHLPGENASSGTELIETKVKGKENECKDIYQKSTVLKDDELKTKL

SEQ ID NO: 563 - protein, 670 aa, Homo sapiens; identical to SEQ ID NO: 562

SEQ ID NO: 564 - protein, 222 aa, Homo sapiens
MLSRAVCGTSRQLAPVLGYLGSRQKHSLPDLPYDYGALEPHINAQIMQLHHSKHHAAYVNNLNVTEEKYQEALAKGDVTAQIALQPALKFNGGGHINHSIFWTNLSPNGGGEPKGELLEAIKRDFGSFDKFKEKLTAASVGVQGSGWGWLGFNKERGHLQIAACPNQDPLQGTTGLIPLLGIDVWEHAYYLQYKNVRPDYLKAIWNVINWENVTERYMACKK

SEQ ID NO: 565 - protein, 222 aa, Homo sapiens; identical to SEQ ID NO: 564

SEQ ID NO: 566 - protein, 183 aa, Homo sapiens
MLSRAVCGTSRQLAPVLGYLGSRQKHSLPDLPYDYGALEPHINAQIMQLHHSKHHAAYVNNLNVTEEKYQEALAKGELLEAIKRDFGSFDKFKEKLTAASVGVQGSGWGWLGFNKERGHLQIAACPNQDPLQGTTGLIPLLGIDVWEHAYYLQYKNVRPDYLKAIWNVINWENVTERYMACKK

SEQ ID NO: 567 - protein, 567 aa, Homo sapiens
MDGSRRVRATSVLPRYGPPCLFKGHLSTKSNAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 568 - protein, 599 aa, Homo sapiens
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 569 - protein, 331 aa, Homo sapiens [sequence omitted]

SEQ ID NO: 570 - protein, 353 aa, Homo sapiens
MENPSPAAALGKALCALLLATLGAAGQPLGGESICSARAPAKYSITFTGKWSQTAFPKQYPLFRPPAQWSSLLGAAHSSDYSMWRKNQYVSNGLRDFAERGEAWALMKEIEAAGEALQSVHAVFSAPAVPSGTGQTSAELEVQRRHSLVSFVVRIVPSPDWFVGVDSLDLCDGDRWREQAALDLYPYDAGTDSGFTFSSPNFATIPQDTVTEVSGHPACARAAMAPAVGTGLGPGCTLASQPRTAACGFCVEEALLLAPAVSKGVQPSHTLPTRGHSTAGRTAGRASRGGRPFLASVSSPCSVGWLRGVHGTLSPTVVQRARWTLGSGPSEAIRIPEGGLLGPQANLLFFLPR

SEQ ID NO: 571 - protein, 331 aa, Homo sapiens [sequence omitted]

SEQ ID NO: 572 - protein, 364 aa, Homo sapiens
MTEKEVLESPKPSFPAETRQSGLQRLKQLLRKGSTGTKEMELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPPGFHRAYSSPLYSNQQYACVKDLSAANRNDPVFETLRTGVIMANKERKKGQADKKNPVAAMMEEEPESARPEEGKPQDGNPEGDKKAEKKTPDDKHKQPGFQQSHYFVALYRFKALEKDDLDFPPGEKITVIDDSNEEWWRGKIGEKVGFFPPNFIIRVRAGERVHRVTRSFVGNREIGQITLKKDQIVVQKGDEAGGYVKVYTGRKVGLFPTDFLEEI

SEQ ID NO: 573 - protein, 622 aa, Homo sapiens
MVKLQRKQIEDQDSSSLGAGVGVEKAGVDGKGATGLGGPCSCSSEAGDGLAEEEEEQVPTDGGTSAEAMQVPLEEDDELEEEEIINDENFLGKRPLDSPEAEELPAMKRPRLLSTKGDTLDVVLLEAREPLSSINTQKIPPMLSPVHVQDSTDLAPPSPEPPMLAPVAKSQMPTAKPLETKSFTPKTKTKTSSPGQKTKSPKTAQSPAMVGSPIRSPKTVSKEKKSPGRSKSPKSPKSPKVTTHIPQTPVRPETPNRTPSATLSEKISKETIQVKQIQTPPDAGKLNSENQPKKAVVADKTIEASIDAVIARACAEREPDPFEFSSGSESEGDIFTSPKRISGPECTTPKASTSANNFTKSGSTPLPLSGGTSSSDNSWTMDASIDEVVRKAKLGTPSNMPPNFPYISSPSVSPPTPEPLHKVYEEKTKLPSSVEIKVEPVALAPSPVIPRLTLRVGAGQDKILLVASNRNPNQTVLEGKTAGVDVTSAGPPAGLPSILGLCPPSSSHLASAVAEVVLATQAVVILGAHSPWRSPASRASVISPREGLRFSSPCGREAALSEGEVCGAQAAPGPLQLEPQWKEQPLSGPPEDSAEVGVGSATSEAVRASAPAQEQAIEVIFL

SEQ ID NO: 574 - protein, 808 aa, Homo sapiens
MAELLASAGSACSWDFPRAPPSFPPPAASRGGLGGTRSFRPHRGAESPRPGRDRDGVRVPMASSRCPAPRGCRCLPGASLAWLGTVLLLLADWVLLRTALPRIFSLLVPTALPLLRVWAVGLSRWAVLWLGACGVLRATVGSKSENAGAQGWLAALKPLAAALGLALPGLALFRELISWGAPGSADSTRLLHWGSHPTAFVVSYAAALPAAALWHKLGSLWVPGGQGGSGNPVRRLLGCLGSETRRLSLFLVLVVLSSLGEMAIPFFTGRLTDWILQDGSADTFTRNLTLMSILTIASAVLEFVGDGIYNNTMGHVHSHLQGEVFGAVLRQETEFFQQNQTGNIMSRVTEDTSTLSDSLSENLSLFLWYLVRGLCLLGIMLWGSVSLTMVTLITLPLLFLLPKKVGKWYQLLEVQVRESLAKSSQVAIEALSAMPTVRSFANEEGEAQKFREKLQEIKTLNQKEAVAYAVNSWTTSISGMLLKVGILYIGGQLVTSGAVSSGNLVTFVLYQMQFTQAVEVLLSIYPRVQKAVGSSEKIFEYLDRTPRCPPSGLLTPLHLEGLVQFQDVSFAYPNRPDVLVLQGLTFTLRPGEVTALVGPNGSGKSTVAALLQNLYQPTGGQLLLDGKPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 575 - protein, 299 aa, Homo sapiens
MITFLYIFFSILIMVLFVLGNFANGFIALVNFIDWVKRKKISSADQILTALAVSRIGLLWALLLNWYLTVLNPAFYSVELRITSYNAWVVTNHFSMWLAANLSIFYLLKIANFSNLLFLHLKRRVRSVILVILLGTLIFLVCHLLVANMDESMWAEEYEGNMTGKMKLRNTVHLSYLTVTTLWSFIPFTLSLISFLMLICSLYKHLKKMQLHGEGSQDLSTKVHIKALQTLISFLLLCAIFFLFLIVSVWSPRRLRNDPVVMVSKAVGNIYLAFDSFILIWRTKKLKHTFLLILCQIRC

SEQ ID NO: 576 - protein, 447 aa, Homo sapiens
MELSQMSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 577 - protein, 631 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHALYSHKPEVAQYTHTGLLPQTMLITDTTNLSALASLTPTKQVFTSDTEASSESGLHTPASQATTLHVPSQDPAGIQHLQPAHRLSASPTVSSSSLVLYQSSDSSNGQSHLLPSNHSVIETFISTQMASSSQ

SEQ ID NO: 578 - protein, 961 aa, Homo sapiens
MLAPRGAAVLLLHLVLQRWLAAGAQATPQVFDLLPSSSQRLNPGALLPVLTDPALNDLYVISTFKLQTKSSATIFGLYSSTDNSKYFEFTVMGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVPPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGIKNILDNCPKFPNRDQRDKDGDGVGDACDSCPDVSNPNQSDVDNDLVGDSCDTNQDSDGDGHQDSTDNCPTVINSAQLDTDKDGIGDECDDDDDNDGIPDLVPPGPDNCRLVPNPAQEDSNSDGVGDICESDFDQDQVIDRIDVCPENAEVTLTDFRAYQTVVLDPEGDAQIDPNWVVLNQGMEIVQTMNSDPGLAVGYTAFNGVDFEGTFHVNTQTDDDYAGFIFGYQDSSSFYVVMWKQTEQTYWQATPFRAVAEPGIQLKAVKSKTGPGEHLRNSLWHTGDTSDQVRLLWKDSRNVGWKDKVSYRWFLQHRPQVGYIRVRFYEGSELVADSGVTIDTTMRGGRLGVFCFSQENIIWSNLKYRCNDTIPEDFQEFQTQNFDRFDN

SEQ ID NO: 579 - protein, 626 aa, Homo sapiens
MMANDAKPDVKTVQVLRDTANRLRIHSIRATCASGSGQLTSCCSAAEVVSVLFFHTMKYKQTDPEHPDNDRFILSRGHAAPILYAAWVEVGDISESDLLNLRKLHSDLERHPTPRLPFVDVATGSLGQGLGTACGMAYTGKYLDKASYRVFCLMGDGESSEGSVWEAFAFASHYNLDNLVAVFDVNRLGQSGPAPLEHGADIYQNCCEAFGWNTYLVDGHDVEALCQAFWQASQVKNKPTAIVAKTFKGRGIPNIEDAENWHGKPVPKERADAIVKLIESQIQTNENLIPKSPVEDSPQISVTDIKMTSPHAYKVGDKIATQKTYGLALAKLGRANERVIVLSGDTMNSTFSEIFRKEHPERFIECIIAEQNMVSVALGCATRGRTIAFAGAFAAFFTRAFDQLRMGAISQANINLIGSHCGVSTGEDGVSQMALEDLAMFRSIPNCTVFYPSDAISTEHAIYLAANTKGMCFIRTSQPETAVIYTPQENFEIGQAKVVRHGVNDKVTVIGAGVTLHEALEAADHLSQQGISVRVIDPFTIKPLDAATIISSAKATGGRVITVEDHYREGGIGEAVCAAVSREPDILVHQLAVSGVPQRGKTSELLDMFGISTRHIIAAVTLTLMK

SEQ ID NO: 580 - protein, 330 aa, Homo sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 581 - protein, 250 aa, Homo sapiens [sequence omitted]

SEQ ID NO: 582 - protein, 234 aa, Homo sapiens
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKNDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 583 - protein, 247 aa, Homo sapiens
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGL

SEQ ID NO: 584 - protein, 933 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 585 - protein, 876 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 586 - protein, 889 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 587 - protein, 760 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 588 - protein, 448 aa, Homo sapiens
MRENVVVSNMERESGKPVAVVAVVTEPWFTQRYREYLQRQKLFDTQHRVEKMPDGSVALPVLGETLPEQHLQELRNRVAPGSPCMLTQLPDPVPSKRAQGCSPAQKLCLEVSRWVEGRGVKWSAELEADLPRSWQRHGNLLLLSEDCFQAKQWKNLGPELWETVALALGVQRLAKRGRVSPDGTRTPAVTLLLGDHGWVEHVDNGIRYKFDVTQCMFSFGNITEKLRVASLSCAGEVLVDLYAGIGYFTLPFLVHAGAAFVHACEWNPHAVVALRNNLEINGVADRCQIHFGDNRKLKLSNIADRVILGLIPSSEEGWPIACQVLRQDAGGILHIHQNVESSPGKNLQALGVSKVEKEHWLYPQQITTNQWKNGATRDSRGKMLSPATKPEWQRWAESAETRIATLLQQVHGKPWKTQILHIQPVKSYAPHVDHIVLDLECCPCPSVG

SEQ ID NO: 589 - protein, 785 aa, Homo sapiens
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNEVKPINKGEEQIGFELVEKLFQGQLVLRTRCLECESLTERREDFQDISVPVQEDELSKVEESSEISPEPKTEMKTLRWAISQFASVERIVGEDKYFCENCHHYTEAERSLLFDKMPEVITIHLKCFAASGLEFDCYGGGLSKINTPLLTPLKLSLEEWSTKPTNDSYGLFAVVMHSGITISSGHYTASVKVTDLNSLELDKGNFVVDQMCEIGKPEPLNEEEARGVVENYNDEEVSIRVGGNTQPSKVLNKKNVEAIGLLGGQKSKADYELYNKASNPDKVASTAFAENRNSETSDTTGTHESDRNKESSDQTGINISGFENKISYVVQSLKEYEGKWLLFDDSEVKVTEEKDFLNSLSPSTSPTSTPYLLFYKKL

SEQ ID NO: 590 - protein, 785 aa, Homo sapiens; identical to SEQ ID NO: 589

SEQ ID NO: 591 - protein, 785 aa, Homo sapiens; identical to SEQ ID NO: 589

SEQ ID NO: 592 - protein, 565 aa, Homo sapiens
MPQASEHRLGRTREPPVNIQPRVGSKLPFAPRARSKERRNPASGPNPMLRPLPPRPGLPDERLKKLELGRGRTSGPRPRGPLRADHGVPLPGSPPPTVALPLPSRTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQACGYRSTTFEVFCDLSLPIPKKGFAGGKVSLRDCFNLFTKEEELESENAPVCDRCRQKTRSTKKLTVQRFPRILVLHLNRFSASRGSIKKSSVGVDFPLQRLSLGDFASDKAGSPVYQLYALCNHSGSVHYGHYTALCRCQTGWHVYNDSRVSPVSENQVASSEGYVLFYQLMQEPPRCL

SEQ ID NO: 593 - protein, 565 aa, Homo sapiens; identical to SEQ ID NO: 592

SEQ ID NO: 594 - protein, 1352 aa, Homo sapiens
MSKVTAPGSGPPAAASGKEKRSFSKRLFRSGRAGGGGAGGPGASGPAAPSSPSSPSSARSVGSFMSRVLKTLSTLSHLSSEGAAPDRGGLRSCFPPGPAAAPTPPPCPPPPASPAPPACAAEPVPGVAGLRNHGNTCFMNATLQCLSNTELFAEYLALGQYRAGRPEPSPDPEQPAGRGAQGQGEVTEQLAHLVRALWTLEYTPQHSRDFKTIVSKNALQYRGNSQHDAQEFLLWLLDRVHEDLNHSVKQSGQPPLKPPSETDMMPEGPSFPVCSTFVQELFQAQYRSSLTCPHCQKQSNTFDPFLCISLPIPLPHTRPLYVTVVYQGKCSHCMRIGVAVPLSGTVARLREAVSMETKIPTDQIVLTEMYYDGFHRSFCDTDDLETVHESDCIFAFETPEIFRPEGILSQRGIHLNNNLNHLKFGLDYHRLSSPTQTAAKQGKMDSPTSRAGSDKIVLLVCNRACTGQQGKRFGLPFVLHLEKTIAWDLLQKEILEKMKYFLRPTVCIQVCPFSLRVVSVVGITYLLPQEEQPLCHPIVERALKSCGPGGTAHVKLVVEWDKETRDFPFVNTEDEYIPDAESVRLQRERHHQPQTCTLSQCFQLYTKEERLAPDDAWRCPHCKQLQQGSITLSLWTLPDVLIIHLKRFRQEGDRRMKLQNMVKFPLTGLDMTPHVVKRSQSSWSLPSHWSPWRRPYGLGRDPEDYIYDLYAVCNHHGTMQGGHYTAYCKNSVDGLWYCFDDSDVQQLSEDEVCTQTAYILFYQRRTAIPSWSANSSVAGSTSSSLCEHWVSRLPGSKPASVTSAASSRRTSLASLSESVEMTGERSEDDGGFSTRPFVRSVQRQSLSSRSSVTSPLAVNENCMRPSWSLSAKLQMRSNSPSRFSGDSPIHSSASTLEKIGEAADDKVSISCFGSLRNLSSSYQEPSDSHSRREHKAVGRAPLAVMEGVFKDESDTRRLNSSVVDTQSKHSAQGDRLPPLSGPFDNNNQIAYVDQSDSVDSSPVKEVKAPSHPGSLAKKPESTTKRSPSSKGTSEPEKSLRKGRPALASQESSLSSTSPSSPLPVKVSLKPSRSRSKADSSSRGSGRHSSPAPAQPKKESSPKSQDSVSSPSPQKQKSASALTYTASSTSAKKASGPATRSPFPPGKSRTSDHSLSREGSRQSLGSDRASATSTSKPNSPRVSQARAGEGRGAGKHVRSSSMASLRSPSTSIKSGLKRDSKSEDKGLSFFKSALRQKETRRSTDLGKTALLSKKAGGSSVKSVCKNTGDDEAERGHQPPASQQPNANTTGKEQLVTKDPASAKHSLLSARKSKSSQLDSGVPSSPGGRQSAEKSSKKLSSSMQTSARPSQKPQ

SEQ ID NO: 595 - protein, 100 aa, Homo sapiens
MEEASEGGGNDRVRNLQSEVEGVKNIMTQNVERILARGENLEHLRNKTEDLEATSEHFKTTSQKVARKFWWKNVKMIVLICVIVFIIILFIVLFATGAFS

SEQ ID NO: 596 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 597 - protein, 242 aa, Homo sapiens
MVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 598 - protein, 367 aa, Homo sapiens
MLLLRCQLKQAPPQKVSFRFCVVMGKQQSKLKHSTYKYGRPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 599 - protein, 366 aa, Homo sapiens
MLLLRCQLKQAPPQKVSFRFCVVMGKQQSKLKHSTYKYGPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 600 - protein, 383 aa, Homo sapiens
MDRTCEERPAEDGSDEEDPDSMEAPTRIRDTPEDIVLEAPASGLAFHPARDLLAAGDVDGDVFVFSYSCQEGETKELWSSGHHLKACRAVAFSEDGQKLITVSKDKAIHVLDVEQGQLERRVSKAHGAPINSLLLVDENVLATGDDTGGIRLWDQRKEGPLMDMRQHEEYIADMALDPAKKLLLTASGDGCLGIFNIKRRRFELLSEPQSGDLTSVTLMKWGKKVACGSSEGTIYLFNWNGFGATSDRFALRAESIDCMVPVTESLLCTGSTDGVIRAVNILPNRVVGSVGQHTGEPVEELALSHCGRFLASSGHDQRLKFWDMAQLRAVVVDDYRRRKKKGGPLRALSSKTWSTDDFFAGLREEGEDSMAQEEKEETGDDSD

SEQ ID NO: 601 - protein, 1432 aa, Homo sapiens
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKLLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 602 - protein, 346 aa, Homo sapiens
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAGKTQLALQLCLAVQFPRQHGGLEAGAVYICTEDAFPHKRLQQLMAQQPRLRTDVPGELLQKLRFGSQIFIEHVADVDTLLECVNKKVPVLLSRGMARLVVIDSVAAPFRCEFDSQASAPRARHLQSLGATLRELSSAFQSPVLCINQVTEAMEEQGAAHGPLGFWDERVSPALGITWANQLLVRLLADRLREEEAALGCPARTLRVLSAPHLPPSSCSYTISAEGVRGTPGTQSH

SEQ ID NO: 603 - protein, 706 aa, Homo sapiens
MALPSPQVLMGLPALLMGPAQHTSWPCGSAVPTLKSMVTFEDVAVYFSQEEWELLDAAQRHLYHSVMLENLELVTSLGSWHGVEGEGAHPKQNVSVEVLQVRIPNADPSTKKANSCDMCGPFLKDILHLAEHQGTQSEEKPYTCGACGRDFWLNANLHQHQKEHSGGKPFRWYKDRDALMKSSKVHLSENPFTCREGGKVILGSCDLLQLQAVDSGQKPYSNLGQLPEVCTTQKLFECSNCGKAFLKSSTLPNHLRTHSEEIPFTCPTGGNFLEEKSILGNKKFHTGEISHVCKECGKAFSHSSKLRKHQKFHTEVKYYECIACGKTFNHKLTFVHHQRIHSGERPYECDECGKAFSNRSHLIRHEKVHTGERPFECLKCGRAFSQSSNFLRHQKVHTQVRPYECSQCGKSFSRSSALIQHWRVHTGERPYECSECGRAFNNNSNLAQHQKVHTGERPFECSECGRDFSQSSHLLRHQKVHTGERPFECCDCGKAFSNSSTLIQHQKVHTGQRPYECSECRKSFSRSSSLIQHWRIHTGEKPYECSECGKAFAHSSTLIEHWRVHTKERPYECNECGKFFSQNSILIKHQKVHTGEKPYKCSECGKFFSRKSSLICHWRVHTGERPYECSECGRAFSSNSHLVRHQRVHTQERPYECIQCGKAFSERSTLVRHQKVHTRERTYECSQCGKLFSHLCNLAQHKKIHT

SEQ ID NO: 604 - protein, 569 aa, Homo sapiens
MSSAPRGPPSVAPLPAGIGRSTAKTPGLPGSLEMGPLTFRDVAIEFSLEEWQCLDTSQQNLYRNVMLDNYRNLVFLGIAVSKPDLITCLEQGKEPCNMKRHAMVAKPPVVCSHFAQDLWPKQGLKDSFQKVILRRYGKYGHENLQLRKGCKSADEHKVHKRGYNGLNQCLTTTQSKIFQCDKYVKVLHKFSNSNIHKKRQTGKKPFKCKECGKSCCILSQLTQHKKTATRVNFYKCKTCGKAFNQFSNLTKHKIIHPEVNPYKCEECGKAFNQSLTLTKHKKIHTEEKPYKCEDCGKVFSVFSVLTKHKIIHTGTKPYNCEECGKGFSIFSTLTKHKIIHTGEKPYKCNECGKAFNWSSTLTKHKRIHTGEKPYKCEECGKAFNQSSTLTRHKIVHTGEKPYKCEECGKAFKRSTTLTKHKRIYTKEKPYKCEECGKAFSVFSTLTKHKIIHTGAKPYKCEECGSAFRAFSTLTEHKRVHTGEKPYKCNECGKAFNWSSTLTKHKRIHTGEKPYKCEECGKAFNRSSNLTRHKKIHTGEKPYKPKRCDSAFDNTPNFSRHKRNHMGEKS

SEQ ID NO: 605 - protein, 659 aa, Homo sapiens [sequence omitted]

SEQ ID NO: 606 - protein, 659 aa, Homo sapiens [sequence omitted]

SEQ ID NO: 607 - protein, 377 aa, Homo sapiens
MKPAQRNLYRDVMLENYSNLVTVGCQVTKPDVIFKLEQEEEPWVMEEEMFGRHCPEVWEVDEQVKKQQETLVRKVTSISKKILIKEKVIECKKVAKIFPLSSDIVTSRQSFYDCDSLDKGLEHNLDLLRYEKGCVREKQSNEFGKPFYHCASYVVTPFKCNQCGQDFSHKFDLIRHERIHAGEKPYECKECGKAFSRKENLITHQKIHTGEKPYKCNECGKAFIQMSNLIRHHRIHTGEKPYACKDCWKAFSQKSNLIEHERIHTGEKPYECKECGKSFSQKQNLIEHEKIHTGEKPYACNECGRAFSRMSSVTLHMRSHTGEKPYKCNKCGKAFSQCSVFIIHMRSHTGEKPYVCSECGKAFSQSSSLTVHAKSYS

SEQ ID NO: 608 - protein, 234 aa, Homo sapiens [sequence omitted]

SEQ ID NO: 609 - protein, 48 aa, Homo sapiens [sequence omitted]

SEQ ID NO: 610 - protein, 49 aa, Homo sapiens
MLLGPRGIFPMVGKQNKCASQNPPNCSWVYYYRLHNAAAFRDASPEKDN

SEQ ID NO: 611 - protein, 114 aa, Homo sapiens [sequence omitted]

SEQ ID NO: 612 - protein, 109 aa, Homo sapiens
AWEHAVIPGSVLNTQKGSLTQVEVINLFNSNRRECDIKVPEVLTDQHLAQTFKLLKEPNRTQLKKTDLLRKAIDLNLVARSLVYLLKSKCSIHHPSLTFEHLARLFFAT

SEQ ID NO: 613 - protein, 59 aa, Homo sapiens
RAIVSVCHEKLICKRLYGMILILCMFINPALYDICELKHWCMNLFSKYKTHHLNILCVK

SEQ ID NO: 614 - protein, 122 aa, Homo sapiens [sequence omitted]

SEQ ID NO: 615 - DNA, 201 bp, Homo sapiens
gctaccagttacatttgacaagtctgtgcaatggatcaaaatcagaagagatgattcaacttggtgaccaagaagtttctgagctttgtggcctaccaagrgagaaactggctgcagcagagcgagtacttcgttccaacatggacatcctgaagccaatcctgagaacactaaactctacatctcccttcccgagcaagg

SEQ ID NO: 616 - DNA, 201 bp, Homo sapiens
cggaattcccaggccctggtattttccttgcaccaagtcctactggtttggcgaggaaagtgatgagaagagccaccctggttccaaccagaagagaatarcagaaatctgcatggaggaggaacccacccacttgaagctgggcgtgtccattcagaacctggtaaaagtctaccgagatgggatgaaggtggctgtcga

SEQ ID NO: 617 - DNA, 201 bp, Homo sapiens
ctggatttactcagtggctgtgatcatcaagggcatcgtgtatgagaaggaggcacggctgaaagagaccatgcggatcatgggcctggacaacagcatcmtctggtttagctggttcattagtagcctcattcctcttcttgtgagcgctggcctgctagtggtcatcctgaagttaggaaacctgctgccctacagtga

SEQ ID NO: 618 - DNA, 201 bp, Homo sapiens
ctgtgcttcaagctgggtgtaaaagtacggacagctatcatggcttctgtatataagaaggcattgaccctatccaacttggccaggaaggagtacaccgrtggagaaacagtgaacctgatgtctgtggatgcccagaagctcatggatgtgaccaacttcatgcacatgctgtggtcaagtgttctacagattgtctta

SEQ ID NO: 619 - DNA, 201 bp, Homo sapiens
tcacttatatttttatcacgttcagtgtgctgggatgaggttacgagtagccatgtgccatatgatttatcggaaggcacttcgtcttagtaacatggccktggggaagacaaccacaggccagatagtcaatctgctgtccaatgatgtgaacaagtttgatcaggtgacagtgttcttacacttcctgtgggcaggacc

SEQ ID NO: 620 - DNA, 201 bp, Homo sapiens
aggacaaggttgcagttctgtcccagaacaggacagagaatgcacagaaagctggccattttgacaaagagattgtaccagttttggtgtcaactagaaarggtcttattgaagttaaaacagatgagtttcctcgccatgggagcaacatagaagccatgtccaagctaaagccttactttcttactgatggaacgggaa

SEQ ID NO: 621 - DNA, 201 bp, Homo sapiens
agattacaacggtgatggcgggcaagcggtccggctggagccgggcggctctcctccagctccttctcggcgtgaacctggtggtgatgccgcccacccgrgcccggagtctgcgcttcgttaccttgctgtaccgccatggagaccgttcaccagtgaagacatatcccaaggacccctatcaggaagaagaatggcccc

SEQ ID NO: 622 - DNA, 201 bp, Homo sapiens
aatggactgataaggaaaaggctggaaagaaaccttcaaatccagccttctggtggatcaacagaaatggagaagagatgcgatggagttttgaggaactyggatctctgtccagaaaatttgccaatatactttcagaagcctgttccctacaaagaggagatcgggtaattctgattctgcccagggtcccagagtggt

SEQ ID NO: 623 - DNA, 201 bp, Homo sapiens; identical to SEQ ID NO: 622

SEQ ID NO: 624 - DNA, 201 bp, Homo sapiens
gtcggcggcacgtgcggggtcgtggacgacgagccccggccgactgggaaagcggagaccgaagacgaggacgaagggactgagggcgaggacgaaggggstcagtggtcgccgcaggacccggcactgcaaggcgtaggacagcccacaggaactggaagcataagaaagaagcgatttgtgtccagtcaccgctatgtg

SEQ ID NO: 625 - DNA, 201 bp, Homo sapiens
tagccggctctgcgcgcccttccaacgaataatagaaattgttaattttaacaatccagagcaggccaacgaggctttgctctcccgacccgaactaaagstccctcgctccgtgcgctgctacgagcggtgtctcctggggctccaatgcagcgagctgtgcccgaggggttcggaaggcgcaagctgggcagcgacatg

SEQ ID NO: 626 - DNA, 201 bp, Homo sapiens
gcccgccgccagcgagcgcctcgccaccgccgccccaggggagaagccgccggcaccactacagttccacctcctgcggcggaatcggcagggcgacgtcmgcggcacgtgcggggtcgtggacgacgagccccggccgactgggaaagcggagaccgaagacgaggacgaagggactgagggcgaggacgaaggggctca

SEQ ID NO: 627 - DNA, 201 bp, Homo sapiens
gtcccagcagagccactctgcctgcgcctgcctctcagtgtctccaactttgcgctggaagaaaaacttcccgcgcgccggcagaactgcagcgcctcctyttagtgactccgggagcttcggctgtagccggctctgcgcgcccttccaacgaataatagaaattgttaattttaacaatccagagcaggccaacgaggc

SEQ ID NO: 628 - DNA, 201 bp, Homo sapiens
tcgggcacttgctccccactcagacacagttttcagaagcagcagcgggagaagacaagatggctgaactctggccggggcgacgaagcttccgaggaagkgcagaatggaagcagtcccaagtcgaagactaagtggactaaagaggatggacatagaacttccacctctgctgtccctaacctgtttgttccattgaac

SEQ ID NO: 629 - DNA, 201 bp, Homo sapiens
tcgggcacttgctccccactcagacacagttttcagaagcagcagcgggagaagacaagatggctgaactctggccggggcgacgaagcttccgaggaagkgcagaatggaagcagtcccaagtcgaagactaaggtgtggacgaacattacacacgatcacgtgaaacccttgctgcagtctctctcgtccggtgtctgc

SEQ ID NO: 630 - DNA, 201 bp, Homo sapiens; identical to SEQ ID NO: 628

SEQ ID NO: 631 - DNA, 201 bp, Homo sapiens; identical to SEQ ID NO: 629

SEQ ID NO: 632 - DNA, 201 bp, Homo sapiens
tttgaggttgagtgacatgttcgaaacctgtccataaagtaattttgtgaaagaaggagcaagagaacattcctctgcagcacttcactaccaaatgagcmttagctacttttcagaattgaaggagaaaatgcattatgtggactgaaccgacttttctaaagctctgaacaaaagcttttctttccttttgcaacaaga

SEQ ID NO: 633 - DNA, 201 bp, Homo sapiens; identical to SEQ ID NO: 632

SEQ ID NO: 634 - DNA, 201 bp, Homo sapiens; identical to SEQ ID NO: 632

SEQ ID NO: 635 - DNA, 201 bp, Homo sapiens; identical to SEQ ID NO: 632

SEQ ID NO: 636 - DNA, 201 bp, Homo sapiens; identical to SEQ ID NO: 632

SEQ ID NO: 637 - DNA, 201 bp, Homo sapiens
actcatttgctggaggtcacccagggctctttcaagatagtaaaaacagtgacttgtacagcataatgaaaaacctaggcattgattttgaagacatcagrcacatgcagaatgaaaaatttttcagaaatgatttttctggtgaggttgacttcagagacattgacttaacggatgaaatcctgacgtatgtccaagatt

SEQ ID NO: 638 - DNA, 201 bp, Homo sapiens
ggagtatgccaagaaacggcccgtgggagaccccttcgatgtcaaaacagaacaggggcctcagattgatcaaaagcagttcgacaaaatcttagagctgrtcgagagtgggaagaaggaaggggccaagctggaatgcgggggctcagccatggaagacaaggggctcttcatcaaacccactgtcttctcagaagtcac

SEQ ID NO: 639 - DNA, 201 bp, Homo sapiens
tgaatacgctttggccgaatacacagaagtgaaaactgtcaccatcaaacttggcgacaagaacccctgaaggaaaggcggggctccttcctcaaacatcsgacggcggaatgtggcagatgaaatgtgctggaggaaaaaaatgacatttctgaccttcccgggacacattcttctggaggctttacatctactggagtt

SEQ ID NO: 640 - DNA, 201 bp, Homo sapiens
ctgcagagatctctgttcgagtccctagagggccggccgtggaagggggacacgtgaatatggcattctctcagtccaaccctccttcggagttgcacaargtccacggatccagaaacaagcccaccagcttgtggaacccaacgtacggctcctggtttacagagaaacccaccaaaaagaataatcctatagcaaaga

SEQ ID NO: 641 - DNA, 201 bp, Homo sapiens
tggaattccagccaacgtgatccgaggagagaagcaatacctggctgcccccctcgttatgctgaagatggagcccaatgggaagctgcagcccatggtcrtccagattcagcctcccaaccccagctctccaaccccaacactgttcctgccctcagaccccccacttgcctggctcctggcaaagtcctgggtccgaaa

SEQ ID NO: 642 - DNA, 201 bp, Homo sapiens
ctggcaggatgatgagttgttcagctaccagttcctcaatggtgccaaccccatgctgttgagacgctcgacctctctgccctccaggctagtgctgcccrcggggatggaagagcttcaggctcaactggagaaagaacttcagaatggttccctgtttgaagctgacttcatccttctggatggaattccagccaacgt

SEQ ID NO: 643 - DNA, 201 bp, Homo sapiens
gagaaggttcgccagtgctggcaggatgatgagttgttcagctaccagttcctcaatggtgccaaccccatgctgttgagacgctcgacctctctgccctrcaggctagtgctgccctcggggatggaagagcttcaggctcaactggagaaagaacttcagaatggttccctgtttgaagctgacttcatccttctggat

SEQ ID NO: 644 - DNA, 201 bp, Homo sapiens
attaatgacgccttcaacctggccagtgcccataaggtccctgtcactctggcgctgaacaacaccctcttcctgattgaagagagacagtacatgccctrggaggccgccctgagcagcctgagctacttcaagctcatgtttgaccgctccgaggtctatggccccatgaagaactacctgaagaagcaggtcacaccc

SEQ ID NO: 645 - DNA, 201 bp, Homo sapiens
ggggacgtggaaggccacttgagcttcctggagaaggacctgagggacaaggtcaactccttcttcagcaccttcaaggagaaagagagccaggacaagawtctctccctccctgagctggagcaacagcaggaacagcagcaggagcagcagcaggagcaggtgcagatgctggcccctttggagagctgagctgcccct

SEQ ID NO: 646 - DNA, 201 bp, Homo sapiens
tcaccctgccagacttccgtttaccagaaatcgcaattccagaattcataatcccaactctcaaccttaatgattttcaagttcctgaccttcacataccygaattccagcttccccacatctcacacacaattgaagtacctacttttggcaagctatacagtattctgaaaatccaatctcctcttttcacattagatg

SEQ ID NO: 647 - DNA, 201 bp, Homo sapiens
tcattttccaactaatagaagataacattaaacagctgaaagagatgaaatttacttatcttattaattatatccaagatgagatcaacacaatcttcagrgattatatcccatatgtttttaaattgttgaaagaaaacctatgccttaatcttcataagttcaatgaatttattcaaaacgagcttcaggaagcttctc

SEQ ID NO: 648 - DNA, 201 bp, Homo sapiens
atgctcggccagagcaccgaggagctgcgggtgcgcctcgcctcccacctgcgcaagctgcgtaagcggctcctccgcgatgccgatgacctgcagaagcycctggcagtgtaccaggccggggcccgcgagggcgccgagcgcggcctcagcgccatccgcgagcgcctggggcccctggtggaacagggccgcgtgcgg

SEQ ID NO: 649 - DNA, 201 bp, Homo sapiens
tttattacaaggataaagccacatttggctgccatgatggatattctctggatggcccggaagaaatagaatgtaccaaactgggaaactggtctgccatkccaagttgtaaagcatcttgtaaagtacctgtgaaaaaagccactgtggtgtaccaaggagagagagtaaagattcaggaaaaatttaagaatggaatgc

SEQ ID NO: 650 - DNA, 185 bp, Homo sapiens
agacagagggagcagtgaatagcaatagggtgtttccaccatggtcttcactcaggccccggctgaaatcatgggccacctccgratacgcagcctcctggcccggcagtgcctggcagagtttctgggtgtgtttgtactcatgctcctcacccaaggagctgtggcccaggctgtcaccagtg

SEQ ID NO: 651 - DNA, 201 bp, Homo sapiens
tgcatcgttggacgcctcccctgggtcaagctccccatttacatcttggtgcagttgctgtctgctttctgtgcttcgggagccacctatgttctctaccytgatgccctacagaactatacaggtgggaacctgacagtgactggccccaaggagacagcctccatttttgccacctatcctgccccctatctgtccctg

SEQ ID NO: 652 - DNA, 201 bp, Homo sapiens
tcttctagttctcagatgtctcccctttccttatatggtgaaaactctaatagtctctcttcagcggagccactgaaggaagataagcctgtcactggtcytaggaacaagactgaaaatggactgactccaaagaaaaaaattcaggtgaattcaaaaccttcaattcagcccaagcctttattgcttccagcagcaccc

SEQ ID NO: 653 - DNA, 201 bp, Homo sapiens
tgataatcttgattttgatttggatttgatgccttgggagtcagacatttgggacatcaacaaccaaatctgtacagttaaagatattaaggcagaacctyagccactttctccagcctcctcaagttattcagtctcgtctcctcggtcagtggactcttattcttcaactcagcatgttcctgaggagttggatttgtc

SEQ ID NO: 654 - DNA, 201 bp, Homo sapiens
gtcagacatttgggacatcaacaaccaaatctgtacagttaaagatattaaggcagaacctcagccactttctccagcctcctcaagttattcagtctcgrctcctcggtcagtggactcttattcttcaactcagcatgttcctgaggagttggatttgtcttctagttctcagatgtctcccctttccttatatggtga

SEQ ID NO: 655 - DNA, 201 bp, Homo sapiens
ggagccggctggggttgccggcaccatggagtcaccttttagcccgggactctttcacaggctggatgaagattgggattctgctctctttgctgaactcygttatttcacagacactgatgagctgcaattggaagcagcaaatgagacgtatgaaaacaattttgataatcttgattttgatttggatttgatgccttg

SEQ ID NO: 656 - DNA, 201 bp, Homo sapiens
tcttcaactcagcatgttcctgaggagttggatttgtcttctagttctcagatgtctcccctttccttatatggtgaaaactctaatagtctctcttcagsggagccactgaaggaagataagcctgtcactggtcctaggaacaagactgaaaatggactgactccaaagaaaaaaattcaggtgaattcaaaaccttca

SEQ ID NO: 657 - DNA, 201 bp, Homo sapiens
tggtagcctcgatgtcctcctctgtgaaactgggatgataataatgcctaccttgtgagggttgcttcaatgattaggaatcattctgtaaagtctagcasagttccttgcatgttgtagcagtgattcagtaagtagcaaccctgtgatactattaccaccacctgctcactggtcaaaacctacacagctgtttcctca

SEQ ID NO: 658 - DNA, 201 bp, Homo sapiens; identical to SEQ ID NO: 657

SEQ ID NO: 659 - DNA, 201 bp, Homo sapiens
cagatgattagggtccaacagatgcatcgaccaaaacttattggagaagaattagcacaactaaaagagcaaagagtccataaaacagacctggaacgagrgttagaagcaaatgatggctcaggaatgttagacgaagatgaggaggatttgcagagggctctggcactaagtcgccaagaaattgacatggaagatgag

SEQ ID NO: 660 - DNA, 201 bp, Homo sapiens
gttagggcatttttcttggatctttttgcagactagctaattagctctcgcctcaggctttttccatatagtttgttttctttttctgtcttgtaggtaakttggctcacatcatgtaatagtggctttcatttcttattaaccaaattaacctttcaggaaagtatctctactttcctgatgttgataatagtaatggtt

SEQ ID NO: 661 - DNA, 201 bp, Homo sapiens
tgattacagcatagggtccactttggtaatgtgtcaaagagatgaggaaataagacttttagcggtttgcaaacaaaatgatgggaaagtggaacaatgcrtcggttgtaggactaaataatgatcttccaaatattagccaaagaggcattcagcaattaaagacatttaaaatagttttctaaatgtttctttttcttt

SEQ ID NO: 662 - DNA, 201 bp, Homo sapiens; identical to SEQ ID NO: 659

SEQ ID NO: 663 - DNA, 201 bp, Homo sapiens; identical to SEQ ID NO: 660

SEQ ID NO: 664 - DNA, 201 bp, Homo sapiens; identical to SEQ ID NO: 661

SEQ ID NO: 665 - DNA, 201 bp, Homo sapiens
ccacctgcaccccttcttgcagcgccagcagcttgcttatggcatctatgtcatccaccaggctggaaatggaacatttaacagggcaaaactgttgaacyttggggtgcgagaggccctgcgtgatgaagagtgggactgcctgttcttgcacgatgtggacctcttgccagaaaatgaccacaatctgtatgtgtgtga

SEQ ID NO: 666 - DNA, 201 bp, Homo sapiens
cctcctttgagatctgccccttcgagtcggagctgaacatggacattgctgcggccctgaagagaggcaaccgtgagtggtacgacaggatcctgaatgamaagagtccccgagagcagccaggaccacagcgcctgcctgggctggttgtgctggctgacgccgtctatgatgaccttcagttctgctacagtgtgtacg

SEQ ID NO: 667 - DNA, 201 bp, Homo sapiens
ccgcggaaggccctgtttccggtcccttgcgcctgcgctcttgcagccaagaaggcgggaggctggagtagagggaagcctgcaaccggaagtgaaggcasatttccctccttcgtcgctgttgctgccgccatacgcgctctccctgtttagctcttctgttagaaatagtatctttgttttcctttgctgttcctcaat

SEQ ID NO: 668 - DNA, 201 bp, Homo sapiens
ccgcggaaggccctgtttccggtcccttgcgcctgcgctcttgcagccaagaaggcgggaggctggagtagagggaagcctgcaaccggaagtgaaggcasatttccctccttcgtcgctgttgctgccgccatacgcgctctccctgtttagttatggcagagaacgatgtggacaatgagctcttggactatgaagatg

SEQ ID NO: 669 - DNA, 201 bp, Homo sapiens
aaggaaggctatctccacgtctgttccaatggcctctgctgttatttactttacgagaggcccaccttatccaaagagctgtatgccctgggggtctttgstgggcttcacacagtacatggcacttactacatccaagtgtgtgccctggtcaggtgtgggggtcttggcttcgacacctgtggacaggaaatcacagag

SEQ ID NO: 670 - DNA, 201 bp, Homo sapiens
tgagccagaaaagtggatgctgccccctcaaggtgctatctcagagaccaggatgggccatccccagttctggaaatacgagttcggtgcctgcaccggcygcctggcttcgctggagcagtactcggagcagctgaaggacatggtggccttcttcctgggctgcagcttctccctggaggaggccttggagaaagcggg

SEQ ID NO: 671 - DNA, 201 bp, Homo sapiens; identical to SEQ ID NO: 670

SEQ ID NO: 672 - DNA, 201 bp, Homo sapiens
aggacatggtggccttcttcctgggctgcagcttctccctggaggaggccttggagaaagcggggctccccagaagagacccagcaggtcacagccaggcyggtgcatacaagacaacagtgccttgtgttacccatgctggcttctgctgccctctggtggtcacgatgaggcccattcccaaggacaagctggaagggc

SEQ ID NO: 673 - DNA, 201 bp, Homo sapiens; identical to SEQ ID NO: 670

SEQ ID NO: 674 - DNA, 201 bp, Homo sapiens
gagagcacagcaactcaaaggctgttatttcagcagttggtaagcaggctgactgctgaagagttacacctggttgctgatgtggaccctggtgaaggccygccccccatcactggagttatttccccactctctgccagtgctatgatcctcactgtgtgccgcaccaaggaggctgaatttcaacgacatgttctccaa

SEQ ID NO: 675 - DNA, 201 bp, Homo sapiens
agtcgtgcatcatcaggatacagagacatcggtaatattcgatatcaagttacggggagagtttgacggctccgttaccttccaccaccccgtgcttcccyctcgatcgatccagccctatcagatccccatcacaggtcctgctgccgtgaccagccagtctcctgttccatgtaaactctattcttcatcttggattgt

SEQ ID NO: 676 - DNA, 201 bp, Homo sapiens
ccatcgtgatcctctacgcacgcatctacttcctggtgaagtccagcagccgtaaggtggccaaccacaacaactcggagcggtccatggcactgctgcgraccgtggtgattgtggtgagcgtgttcatcgcctgctggtccccactcttcatcctcttcctcattgatgtggcctgcagggtgcaggcgtgccccatcc

SEQ ID NO: 677 - DNA, 201 bp, Homo sapiens
agcaccttcctgaaggacgcgccaggggagttcctgctccgagtcttctctaccgggcgagtctcccttagcgccatcagggcagtggccaagaacaccarccccggggcagccctgcctgcgggggagtgggggaccgtgcagctacggggttcttggagagtcggccagacggcggggggcagcaggaactttgcctca

SEQ ID NO: 678 - DNA, 201 bp, Homo sapiens
agtctcccttttccggtgtgtgagtcctgtcccctttacaagaagctccgcctgtcgacagatactgtggaacactccctagacaataaagatggtcctgsctgccttcaggtgaagccttgcactcctgaattttatcaaacacacttccagctggcatataggttgcagtctcggcctcgtggcctagcactggtgttg

SEQ ID NO: 679 - DNA, 201 bp, Homo sapiens
cctttgatattatgtggcttttatttcagtgccatacatgttattgttttcaacctagaaacctttatccctgcttatctgaaacttcccaacttccctgwtctttaagactttttttttttttttttttttttttgagacagagtctcgctctgtcgcccaggctggagggcagtggcacgatctcagctcactgcaagc

SEQ ID NO: 680 - DNA, 201 bp, Homo sapiens; identical to SEQ ID NO: 679

SEQ ID NO: 681 - DNA, 201 bp, Homo sapiens
cagcagcagcccagatgcaagcagaaggtcatctttggcagcggcacggtcaccttctcactgagctttgatgagcctcagaagaacgccatggcccacargaattctacgcaccagaactccctggaggcccagaaaagcagcgatacgctgacccgacaccagccattactcccgctgcagtgcggggaaacggactta

SEQ ID NO: 682 - DNA, 201 bp, Homo sapiens
ttcctcctctcactggcagtcagcgacctcctgctggctgtggcttgcatgcccttcaccctcctgcccaatctcatgggcacattcatctttggcaccgrcatctgcaaggcggtttcctacctcatgggggtgtctgtgagtgtgtccacgctaagcctcgtggccatcgcactggagcggtacagcgccatctgccga

SEQ ID NO: 683 - DNA, 186 bp, Homo sapiens
atggcaggcctgatgaccatagtaaccagccttctgttccttggtgtctgtgcccaccacatcatccctacgggctctgtggtcamcccctctccctgctgcatgttctttgtttccaagagaattcctgagaaccgagtggtcagctaccagctgtccagcaggagcacatgcctcaaggcagga

SEQ ID NO: 684 - DNA, 201 bp, Homo sapiens
acaagggaaactttttctcagccaggaggagggtgccctgtggcatcattacaagtgtcctggcatgggtaacagccattctggccactttgcctgaattwgtggtttataaacctcagatggaagaccagaaatacaagtgtgcatttagcagaactcccttcctgccagctgatgagacattctggaagcattttctga

SEQ ID NO: 685 - DNA, 201 bp, Homo sapiens
gctgtgcagacaaagggaaaatcaaccctgcatctttagacaaggccatgtccattcccatgtgggtggacaatgttcagtgtccaaaaggacctgacacyctgtggcagtgcccatcatctccatgggagaagagactggccagcccctcggaggagacctggatcacatgtgacaacaagataagacttcaggaaggac

SEQ ID NO: 686 - DNA, 201 bp, Homo sapiens; identical to SEQ ID NO: 685

SEQ ID NO: 687 - DNA, 201 bp, Homo sapiens
ggaagaggacacagagccagcaggggcttcaggagaattccagcggccagagcttctttgtgaggaataaaaaggttagaagggcccccctctctgaagarccccactccctgggatgctacaatccaatgatggaagatggcattagctacaccaccctgcgctttcccgagatgaacataccacgaactggagatgcag

SEQ ID NO: 688 - DNA, 201 bp, Homo sapiens; identical to SEQ ID NO: 687

SEQ ID NO: 689 - DNA, 201 bp, Homo sapiens; identical to SEQ ID NO: 687

SEQ ID NO: 690 - DNA, 201 bp, Homo sapiens; identical to SEQ ID NO: 687

SEQ ID NO: 691 - DNA, 201 bp, Homo sapiens
caatccaggcaactcctagtagtacaacggaagaaacagctacccagaaggaacagtggtttggcaacagatggcatgagggatatcgccaaacacccaargaagactcccattcgacaacagggacagctgcagcctcagctcataccagccatccaatgcaaggaaggacaacaccaagcccagaggacagttcctgga

SEQ ID NO: 692 - DNA, 201 bp, Homo sapiens; identical to SEQ ID NO: 691

SEQ ID NO: 693 - DNA, 201 bp, Homo sapiens
tgggactgcccggggctgccaggacagcactactgcggccacaaagaggacgcgggcgtggtgtgctcagagcaccagtcctggcgcctgacagggggcgrtgaccgctgcgaggggcaggtggaggtacacttccgaggggtctggaacacagtgtgtgacagtgagtggtacccatcggaggccaaggtgctctgccag

SEQ ID NO: 694 - DNA, 201 bp, Homo sapiens
cagtgtgcgatgacacttgggacctggaggacgcccacgtggtgtgcaggcaactgggctgcggctgggcagtccaggccctgcccggcttgcacttcatycccggccgcgggcctatccaccgggaccaggtgaactgctcgggggccgaagcttacctgtgggactgcccggggctgccaggacagcactactgcggcc

SEQ ID NO: 695 - DNA, 201 bp, Homo sapiens
ggacacctcagctttggattcatgcaggacctccagcagaaggttgtctacctgagctacatggcggtggagtacaatgtgtccttcccccacgcagcacmgtggacattctcggctcagaatgcatcccttcgagatctccaagcacccctggggcagagcttcagttgcagcaactcgagcatcattctttcaccagct

SEQ ID NO: 696 - DNA, 201 bp, Homo sapiens; identical to SEQ ID NO: 695

SEQ ID NO: 697 - DNA, 201 bp, Homo sapiens
aagaagaaggatccaaagtgtatatttgcatgtgaagagatgtcaggagaagttcggtttagtagccatttacctcaaccaaatagcctttgtagtttagragtagaacccatggaaaactggctacagttgatgttgaattgggaccctcagcagagaggaggacctgttgaccttactttgaagcagccaagatgtttt

SEQ ID NO: 698 - DNA, 201 bp, Homo sapiens
acaaaagttgggactacaagcaagtgacataaaaagcttctcagctctcgcagagcttgttgctgctgccaaggaccaggcaacagcagagcagccttaarcatcttggaagatcccgaggttagattcttaagcaagagaagagttggacttccaggctgaaggggagaaagtgactctgttctcttagcaaccgtctgt

SEQ ID NO: 699 - DNA, 201 bp, Homo sapiens
agcatatagtgtttccatattcctatacacgaagtaaaagcaaagaccatgaggaactgtctctagtagccagtgaagcagttcgtgctattgagaaaacyagtaaaaataccaggtatacacatggccatggctcagaaaccttatacctagctcctggaggtggggacgattggatctatgatttgggcatcaaatatt

SEQ ID NO: 700 - DNA, 201 bp, Homo sapiens; identical to SEQ ID NO: 699

SEQ ID NO: 701 - DNA, 201 bp, Homo sapiens
ctccgaggacgagggccgctcatggtgaacagcaactattatgccatggatctgctgtatatccttccaactcacattcaggcagcaagagccggcaacgrcatccatgccatcctgctttacaggcgcaaactggaccgggaggaaatcaaaccaattcgtcttttgggatccacgattccactctgctccgctcagtgg

SEQ ID NO: 702 - DNA, 201 bp, Homo sapiens; identical to SEQ ID NO: 701

SEQ ID NO: 703 - DNA, 201 bp, Homo sapiens
ccttgttgctttgaaatcttagaagagagcccactaattcaaggactcttactgtgggagcaactgctggttctatcacaatgaaacggctggtttgtgtyctcttggtgtgctcctctgcagtggcacagttgcataaagatcctaccctggatcaccactggcatctctggaagaaaacctatggcaaacaatacaagg

SEQ ID NO: 704 - DNA, 201 bp, Homo sapiens
gttctgtggcacgctgtgtccatggcatctgtgaggatttaatgcgagagcaagctggagagcccaagtacagctgcgtctgtgatgctgggtggatgttytcacccaacagccctgcctgcacgctggacagagacgagtgcagcttccagcccgggccttgctccacacttgtgcagtgtttcaacactcaaggctctt

SEQ ID NO: 705 - DNA, 201 bp, Homo sapiens
agtaatggaggctgccacccagatgcctcatgctcctcaactctaggttccttacctctctgcacgtgtctcccgggttatactggaaatggttatgggcmaaatggatgtgtgcagctcagtaatatttgcctaagtcacccctgtctaaatggacaatgcatcgacactgtctctggttatttttgtaagtgtgactca

SEQ ID NO: 706 - DNA, 201 bp, Homo sapiens
cagacgctgttttcctgcaagaaccacaagaaagccaaagccattaaactgatccttctggtggtcatcgtgtttttcctcttctggacaccctacaacgrtatgattttcctggagacgcttaagctctatgacttctttcccagttgtgacatgaggaaggatctgaggctggccctcagtgtgactgagacggttgca

SEQ ID NO: 707 - DNA, 201 bp, Homo sapiens
ctgatgctgactagtgaggaaagatttttgttgttatttcttacaggcacaaaatgatggacccaatgcacacaaaacaaccctagagtgttgttgagaaytgtgctcaaaatttgaagaatgaacaaattgaactctttgaatgacaaagagtagacatttctcttactgcaaatgtcatcagaactttttggtttgcag

SEQ ID NO: 708 - DNA, 201 bp, Homo sapiens
aagcagaaatacatatttccaagaagttggatgggtgggtactattctgattacacaaaacaaatgccacacatcacccttaccatgtgcctgatccagcytctcccctgattacaccagcctcgtcttcattaagccctcttccatcatgtccccaaacctgcaagggctccccactgcctactgcatcgagtcaaaact

SEQ ID NO: 709 - DNA, 201 bp, Homo sapiens
ttcatgaatcgtctccggaaacacctgagagcttaccatcggtgtctatactacacgaggttccagctcctttcctggagcgtgtgtgggggcaacaaggycccatgggttcaggaattgatgagctgtcttgatctcaaagaatgtggacatgcttactcggggattgtggcccaccagaagcatttacttcctaccagc

SEQ ID NO: 710 - DNA, 201 bp, Homo sapiens
caccagaagcatttacttcctaccagccccccaatttctcaggcctcagagggggcatcttcagatatccacacccctgcccagatgctcctgtccacctygcagtccactcagcgccccaccctcccagtaggatcactgtcctcggacaaagagctcactcgtcccaatgaaaccaccattcacactgcgggccacagt

SEQ ID NO: 711 - DNA, 201 bp, Homo sapiens
ggtgcctactccattgtggcgggcgtgtttgtgtgcctgctggagtacccccgggggaagaggaagaagggctccaccatggagcgctggggacagaagtycatgaccgccgtggtgaagctgttcgggccctttaccaggaattactatgttcgggccgtcctgcatctcctgctctcggtgcccgccggcttcctgctg

SEQ ID NO: 712 - DNA, 201 bp, Homo sapiens
cgccatgtcacccaggacattgtgctcccagacggccgggtcatccccaaaggcattatctgcctcatcagtgttttcggaacccatcacaacccagctgrgtggccggaccctgaggtctacgacccctttcgctttgacccagagaacatcaaggagaggtcacctctggcttttattcccttctcggcagggcccagg

SEQ ID NO: 713 - DNA, 201 bp, Homo sapiens
tccaagatgaaacccgaccgcctcaactactgccgccacgtgctggccgcctgggccctgggtgccaaggcattttactacccagaggaagccggccttgkcttcgggggtccagggtcctccagatatctccgcctggaagttcactaccacaacccactggtgatagaaggacgaaacgactcctcaggcatccgcttg

SEQ ID NO: 714 - DNA, 199 bp, Homo sapiens
atgctgggagatgcagtccctttttctaaagactggggcggccgtgaggtcatcggtggtcgccgggagccgccagcacgtggcggcgaggaaggggcygtgtgctcctgttgtctgcacctgagagggggcaggagctctcggcgcttgcgcctcccgccgcggtgccctcccgacatgccggaggaggcgggcttcc

SEQ ID NO: 715 - DNA, 201 bp, Homo sapiens
gtaagagatgggatattggtggtaggaatggattgtgaaatgcatgtatatgcacagtggaagcatgctgtcaaatttggagacactgaagctgatagttytaatgcagaagaggcagcaatgcaagatcattcgacctttaaatctaatatgctggcaagaaaaagtgttgttgaaggaacagctatttctgatgatgtt

SEQ ID NO: 716 - DNA, 201 bp, Homo sapiens
ctccatctggctcctcctggcgcctacaccccctctcagccactgtcttcagtctccacagaaacagcatcaagtgtgcggagacaggcggctgaaagccrgcagcacgaactgcccgtcagagaagtgcacagcctgggccagatactcccacaggatggactcactgcagaagcaggacctccggaggcccaagatcca

SEQ ID NO: 717 - DNA, 201 bp, Homo sapiens
tccatctggctcctcctggcgcctacaccccctctcagccactgtcttcagtctccacagaaacagcatcaagtgtgcggagacaggcggctgaaagccarcagcacgaactgcccgtcagagaagtgcacagcctgggccagatactcccacaggatggactcactgcagaagcaggacctccggaggcccaagatccat

SEQ ID NO: 718 - DNA, 201 bp, Homo sapiens; identical to SEQ ID NO: 676

SEQ ID NO: 719 - DNA, 201 bp, Homo sapiens
aatcagaagaagttcagaggaacacctaagacaaaccaggtcggagaccatgagaaacagcgtcaaatcatcttttcatgatcccaagctgaaaggcaagkcctccagagagcgttatgtgacccacaaccgagcacattggtgacagaccttcggggcctgtctgaagccatagcctccacggagagccctgtggccgac

SEQ ID NO: 720 - DNA, 201 bp, Homo sapiens; identical to SEQ ID NO: 719

SEQ ID NO: 721 - DNA, 201 bp, Homo sapiens; identical to SEQ ID NO: 719

SEQ ID NO: 722 - DNA, 201 bp, Homo sapiens; identical to SEQ ID NO: 719

SEQ ID NO: 723 - DNA, 135 bp, Homo sapiens
ttgtttaattctttctttgagataattttacctttgatgtttcaaaagcagtgtcacatacatgaagaagttcagcaagaattagccccaaagcgtasaggtccacttcctttccatagtcttgcgaagaaatct

SEQ ID NO: 724 - DNA, 201 bp, Homo sapiens
aatcagcttttaaaagcagtgcatcttcaaggccatgaaggacctgtttatgcggtgcatgctgtttaccagaggaggacatcagatcctgcattatgtamactgatcgtttctgcagctgcagattctgctgttcgactctggtctaaaaagggtccagaagtaatgtgccttcagactttaaactttggaaatggattt

SEQ ID NO: 725 - DNA, 201 bp, Homo sapiens
ggcagaagcccttcgcctgctgcggctgcaggtgcccccttcctccctgcagggctctggcacaccagctcctccgggggacagtcttgcagcccccccargactgccacccacgtgcaccccttccttggtgagccgaggcacccagacggagacagaggtggagctcaagtcatcccctggaccccctggcctgagcaa

SEQ ID NO: 726 - DNA, 201 bp, Homo sapiens
attccccagtaacaacttgctgggactgcacaacgtggtccactaaccaacaatcactagggccaattatgcttaccaaaataccattagaaccagattgraaaacaagcacttgcaattctgtaaatcttaccatcttagagccagatcagcccatatggacaacaggtttaaaagcaccgctaggggcacgagtcagcg

SEQ ID NO: 727 - DNA, 201 bp, Homo sapiens
ctgtcagaagatgacctgttgagtcagtattctctttcatttacgaagaagaccaagaaaaatagctctgaaggcaataaatcattgagcttttctgaagrgtttgtgcctgacctggtaaatggacctactaacaaaaagagtgtaagcactccacctaggacgagaaataaatttgcaacatttttacaaaggaaaaat

SEQ ID NO: 728 - DNA, 201 bp, Homo sapiens; identical to SEQ ID NO: 727

SEQ ID NO: 729 - DNA, 201 bp, Homo sapiens; identical to SEQ ID NO: 727

SEQ ID NO: 730 - DNA, 201 bp, Homo sapiens
gttctggccaagcaaaagtccaccgtgctaaccatccctgagatcatcatcaaggtccgtggcactcaggtagttggttctgacatgactgtgacagttgsgtttaccaatcctttaaaagaaaccctgcgaaatgtctgggtacacctggatggtcctggagtaacaagaccaatgaagaagatgttccgtgaaatccgg

SEQ ID NO: 731 - DNA, 201 bp, Homo sapiens
tcagaaacttccaggaccgcctttggaggcagaagagcagttccacccaataactctaatgcagcggaagatgacctgcccacagtggagcttcagggcgkggtgccccggggcgtcaacctgcaagagtttcttaatgtcacgagcgttcacctgttcaaggagagatgggacactaacaaggtggaccaccacactgac

SEQ ID NO: 732 - DNA, 201 bp, Homo sapiens
gctacggccacgcgctgaggctgaccgcagtggtgctggcctccgccgtggccttcttcgtgcccagcaacctgctgctgctgctgcattactcggacccyagccccagcgcctggggcaacctctatggtgcctacgtgcccagcctggcgctgagcaccctcaacagctgcgtggatcccttcatctactactacgtgt

SEQ ID NO: 733 - DNA, 201 bp, Homo sapiens
tactcagctgtgaacccagaaaaagatattcactcaggcttgataggtcccctcctaatctgccaaaaaggaatactacataaggacagcaacatgcctarggacatgagagaatttgtcttactatttatgacctttgatgaaaagaagagctggtactatgaaaagaagtcccgaagttcttggagactcacatcctca

SEQ ID NO: 734 - DNA, 201 bp, Homo sapiens
aacgaattcacggtgggggaggaatgtgagctggagacaatgacaggggagaaagtcaagacagtggttcagttggaaggtgacaataaactggtgacaartttcaaaaacatcaagtctgtgaccgaactcaacggcgacataatcaccaataccatgacattgggtgacattgtcttcaagagaatcagcaagagaatt

SEQ ID NO: 735 - DNA, 201 bp, Homo sapiens
gctcttttttaaggagcctcagggccactcctggttcaaaaacaagggtcacatcacatgacagagaggtagatatcgtggctaagacggtggagaagcayaacatagaggccaaagtggagaaagcccagggtggccaggagctggagatgatcagtggcactatgacatccgagaagacggagatgatcgtctttgaaa

SEQ ID NO: 736 - DNA, 201 bp, Homo sapiens
cccaagtacttcctgtccattgagtgcagccggaagagctcctcttccctcagtgacgtgaccacagtcatggtcaacatcactgatgtcaatgaacaccygccccaattcccccaagatccatatagcacaagggtcttagagaatgcccttgtgggtgacgtcatcctcacggtatcagcgactgatgaagatggaccc

SEQ ID NO: 737 - DNA, 201 bp, Homo sapiens
tgaccggccaggaaacggtcgcccagatcaaggctcatgtagcctcactggagggcattgccccggaagatcaagtcgtgctcctggcaggcgcgcccctwgaggatgaggccactctgggccagtgcggggtggaggccctgactaccctggaagtagcaggccgcatgcttggaggtaaagtccatggttccctggccc

SEQ ID NO: 738 - DNA, 201 bp, Homo sapiens
aggtgcggcccatcgtgggcccatttcatgccgtcctgaagctggagatgaactatgtggtcgggggcgtggtctcccaccgaaatgttgtcaacgtccaratcttcgtctctgagtactggttctgagggctggtctgccgcacagccgcaggtgcacctccaggccaaatcattgctgccagtgactgtggtctgtact

SEQ ID NO: 739 - DNA, 201 bp, Homo sapiens
gagactgatcctgagttcgtcattgaccacatggacgcaaacaaggcagggcgctatcagtgccaatataggatagggcactacagattccggtacagtgrcaccctggagctggtagtgacaggcttgtatggcaaacccttcctctctgcagatcggggtctggtgttgatgccaggagagaatatttccctcacgtgc

SEQ ID NO: 740 - DNA, 201 bp, Homo sapiens; identical to SEQ ID NO: 739

SEQ ID NO: 741 - DNA, 201 bp, Homo sapiens
gagactgatcctgagttcgtcattgaccacatggacgcaaacaaggcagggcgctatcagtgccaatataggatagggcactacagattccggtacagtgrcaccctggagctggtagtgacagactccatccaccaagattacacgacgcagaacttgatccgcatggccgtggcaggactggtcctcgtggctctcttg

SEQ ID NO: 742 - DNA, 201 bp, Homo sapiens; identical to SEQ ID NO: 739

SEQ ID NO: 743 - DNA, 201 bp, Homo sapiens; identical to SEQ ID NO: 741

SEQ ID NO: 744 - DNA, 201 bp, Homo sapiens; identical to SEQ ID NO: 739

SEQ ID NO: 745 - DNA, 201 bp, Homo sapiens; identical to SEQ ID NO: 739

SEQ ID NO: 746 - DNA, 201 bp, Homo sapiens; identical to SEQ ID NO: 739

SEQ ID NO: 747 - DNA, 201 bp, Homo sapiens
acgcccgccgcctcactgttatgagccttcaggaatcgggattaaaagttaaccagccagcatcctttgctataaggttgaatggcgcaaaaggcaagatygatgcaaaggtgcacagcccctctggagccgtggaggagtgccacgtgtctgagctggagccagataagtatgctgttcgcttcatccctcatgagaatg

SEQ ID NO: 748 - DNA, 201 bp, Homo sapiens
caaacttggtggcaacttgcctcccggtgcgggcgtctctcccccaccgtctcaacatgcttaggggtccggggcccgggctgctgctgctggccgtccawtgcctggggacagcggtgccctccacgggagcctcgaagagcaagaggcaggctcagcaaatggttcagccccagtccccggtggctgtcagtcaaagca

SEQ ID NO: 749 - DNA, 201 bp, Homo sapiens; identical to SEQ ID NO: 748

SEQ ID NO: 750 - DNA, 201 bp, Homo sapiens; identical to SEQ ID NO: 748

SEQ ID NO: 751 - DNA, 201 bp, Homo sapiens; identical to SEQ ID NO: 748

SEQ ID NO: 752 - DNA, 201 bp, Homo sapiens; identical to SEQ ID NO: 748

SEQ ID NO: 753 - DNA, 201 bp, Homo sapiens; identical to SEQ ID NO: 748

SEQ ID NO: 754 - DNA, 201 bp, Homo sapiens; identical to SEQ ID NO: 748

SEQ ID NO: 755 - DNA, 201 bp, Homo sapiens
acaaggagcttttataactctggttgcacgaaatgaggataagctgctgcaggcaaagaaagaaattgaaatgcactctattaatgacaaacaggtggtgrtttgcatatcagttgatgtatctcaagactataaccaagtagagaatgtcataaaacaagcacaggagaaactgggtccagtggacatgctggtaaattg

SEQ ID NO: 756 - DNA, 201 bp, Homo sapiens
gggaagatcatttcttatttgtgctctgtgactgccaaggtgtggcctgcactgggttgtccagggagacctagtgctgtttctcccacatattcacataygtgtctgtgtgtatatatattttttcaatttaaaggttagtatggaatcagctgctacaagaatgcaaaaaatcttccaaagacaagaaaagaggaaaaa

SEQ ID NO: 757 - DNA, 201 bp, Homo sapiens
attaaagggtagcctacaaatgttttcaggcttctttcaaagtgtaagcacttctgagctctttagcattgaagtgtcgaaagcaactcacacgggaagaycatttcttatttgtgctctgtgactgccaaggtgtggcctgcactgggttgtccagggagacctagtgctgtttctcccacatattcacatacgtgtctg

SEQ ID NO: 758 - DNA, 201 bp, Homo sapiens
tgtagaaagaatgtgttgcctcctaccttgcccccaagttctgatttttaatttctatggaagattttttggattgtcggatttcctccctcacatgataycccttatcttttataatgtcttatgcctatacctgaatataacaacctttaaaaaagcaaaataataagaaggaaaaattccaggagggaaaatgaattg

SEQ ID NO: 759 - DNA, 201 bp, Homo sapiens
gcaactcacacgggaagatcatttcttatttgtgctctgtgactgccaaggtgtggcctgcactgggttgtccagggagacctagtgctgtttctcccacrtattcacatacgtgtctgtgtgtatatatattttttcaatttaaaggttagtatggaatcagctgctacaagaatgcaaaaaatcttccaaagacaagaa

SEQ ID NO: 760 - DNA, 201 bp, Homo sapiens
aattccaggagggaaaatgaattgtcttcactcttcattctttgaaggatttactgcaagaagtacatgaagagcagctggtcaacctgctcactgttctrtctccaaatgagacacattaaagggtagcctacaaatgttttcaggcttctttcaaagtgtaagcacttctgagctctttagcattgaagtgtcgaaagc

SEQ ID NO: 761 - DNA, 201 bp, Homo sapiens
gcaaaaaatcttccaaagacaagaaaagaggaaaaaaagccgttttcatgagctgagtgatgtagcgtaacaaacaaaatcatggagctgaggaggtgccktgtaaacatgaaggggcagataaaggaaggagatactcatgttgataaagagagccctggtcctagacatagttcagccacaaagtagttgtccctttgt

SEQ ID NO: 762 - DNA, 201 bp, Homo sapiens; identical to SEQ ID NO: 756

SEQ ID NO: 763 - DNA, 201 bp, Homo sapiens; identical to SEQ ID NO: 757

SEQ ID NO: 764 - DNA, 201 bp, Homo sapiens; identical to SEQ ID NO: 758

SEQ ID NO: 765 - DNA, 201 bp, Homo sapiens; identical to SEQ ID NO: 759

SEQ ID NO: 766 - DNA, 201 bp, Homo sapiens; identical to SEQ ID NO: 760

SEQ ID NO: 767 - DNA, 201 bp, Homo sapiens; identical to SEQ ID NO: 761

SEQ ID NO: 768 - DNA, 201 bp, Homo sapiens
tatcaaggtctccagcgagtgaaaatcatagcaagtgataatctctgggagtccatctctgcatccatgctccttgatgccgaactcttcaaggtggttgrtgttataggggctcattatcctggaacccattcagcaaaagatgcaaagttgactgggaagaagctttggtcttctgaagactttagcactttaaatagt

SEQ ID NO: 769 - DNA, 201 bp, Homo sapiens; identical to SEQ ID NO: 768

SEQ ID NO: 770 - DNA, 201 bp, Homo sapiens
gacagaccaggcttcgggggtaggaggatctgcagttgttcagccgtctttctgctggtgttgtctttctgccatcagagaagggacacacagcccgttcraaggtgtgcagagggctctgagcgccaggatggccagggctgtttttgctactgaaggagcgtgtgtcctgaactcccacttgcagggacagtccccacc

SEQ ID NO: 771 - DNA, 201 bp, Homo sapiens
gctcaagatacccctgattcaccgagccctgcagttggcccagcgtcccgtttcactccttgccagcccctggacatcacccacttggctcaagaccaatkgagcggtgaatgggaaggggtcactcaagggacagcccggagacatctaccaccagacctgggccagatactttgtgaagttcctggatgcctatgctga

SEQ ID NO: 772 - DNA, 201 bp, Homo sapiens; identical to SEQ ID NO: 771

SEQ ID NO: 773 - DNA, 201 bp, Homo sapiens; identical to SEQ ID NO: 771

SEQ ID NO: 774 - DNA, 201 bp, Homo sapiens; identical to SEQ ID NO: 771

SEQ ID NO: 775 - DNA, 201 bp, Homo sapiens; identical to SEQ ID NO: 771

SEQ ID NO: 776 - DNA, 201 bp, Homo sapiens
ctggcagaatcttcgtccgcacggccccagctggagttgcacttgcggccgcaagccgccagggggcgccgcagagcgcgtgcgcgcaacggggaccactstccgctcgggcccgggcgttgctgccgtctgcacacggtccgcgcgtcgctggaagacctgggctgggccgattgggtgctgtcgccacgggaggtgcaa

SEQ ID NO: 777 - DNA, 201 bp, Homo sapiens
tccagtgagcagaactgggccaacctgaccacagaggagaggctggcgtcttccaggccccctctcttcctggacccaccccctcagaatggccaaaaacycccaagtcgtcccagcagctctgcttctaagaagcagtatgtatagaggcctgtggcttatgtcacccaacagaggggtcctgagaagtctggctgcctg

SEQ ID NO: 778 - DNA, 201 bp, Homo sapiens
aaaacgaaatccaagcaagcatagaccagatattcagccgtctagaacgtctggagattttgtccagcaaggagccccctaacaaaaggcaaaatgccagrcttcgggttgaccagttaaagtatgatgtccagcacctgcagactgcgctcagaaacttccagcatcggcgccatgcaagggagcagcaggagagacagc

SEQ ID NO: 779 - DNA, 201 bp, Homo sapiens; identical to SEQ ID NO: 778

SEQ ID NO: 780 - DNA, 201 bp, Homo sapiens
caccctctagtggaggcgggggtgaattcttaggtcgagctgatgcaagaaactccggtagccagcctctgtgaccttgtacatgagtttggtgtgcctaytgtgatttaaaacaggtgggttatcaagaggaacttgagatctctttattacatggacatttacttcagggggaccactgtaagaaaagccaaactccaa

SEQ ID NO: 781 - DNA, 201 bp, Homo sapiens
catagctcccctttggtaagttttcttaattgtcatagattaactgagtttcctggatgctaatttcacactttcggttggaggagatctccattgttccyacccctccgggccaaatgggccccaggtttccaaggaaggagcaatctgtgactcctaaaatgggttggggccctgccagagttaaagcagtgactggag

SEQ ID NO: 782 - DNA, 201 bp, Homo sapiens; identical to SEQ ID NO: 778

SEQ ID NO: 783 - DNA, 201 bp, Homo sapiens; identical to SEQ ID NO: 780

SEQ ID NO: 784 - DNA, 201 bp, Homo sapiens
ctctggcctcgccctgccccgggtccccaacgccaagggacagtgtcatctcgatcggcacctccgcctgtctggttgcagcctcagccgtcccgagcggrctccacctcccagaagtctccctggaccgagcatctctcccctgctcccaggaggaagcgacaggaggagccaaggacaccaggatggtccaccaaaccc

SEQ ID NO: 785 - DNA, 201 bp, Homo sapiens
caggccaggactcttgtcaagagagagggcttcaagaggccgtccggagagagcatcaggaggccagtgttcccaagggccgcattgtgccaaggggaatygacaggctggagagaactagatcaagccggaagagcaaacatcaggaggcaacggaaacctctctcctccattcccaccgctttaaaaagggccaaaagc

SEQ ID NO: 786 - DNA, 201 bp, Homo sapiens
caataaagtctgcagataatcaggttcctccaccagtcagtgcagctcttcaagggattaaaagtattgtgacactttcaatggccaaaactgaggctggsgttcaaaaacagtggacagctctgattcgtagcacgcttgcttgcatcctggaatattctcaaccagaagactctgtacctacacctgatgaagtaagca

SEQ ID NO: 787 - DNA, 201 bp, Homo sapiens
ctggggccatcaaggcggaccatgtgtcaacttatgccgcgtttgtacagacgcatagaccaacaggggagtttatgtttgaatttgatgaagatgagatwttctatgtggatctggacaagaaggagaccgtctggcatctggaggagtttggccaagccttttcctttgaggctcagggcgggctggctaacattgcta

SEQ ID NO: 788 - DNA, 201 bp, Homo sapiens
gaccaacaggggagtttatgtttgaatttgatgaagatgagatgttctatgtggatctggacaagaaggagaccgtctggcatctggaggagtttggccargccttttcctttgaggctcagggcgggctggctaacattgctatattgaacaacaacttgaataccttgatccagcgttccaaccacactcaggccacca

SEQ ID NO: 789 - DNA, 201 bp, Homo sapiens
catatcagagctgtgatcttgagagccctctccttggctttcctgctgagtctccgaggagctggggccatcaaggcggaccatgtgtcaacttatgccgrgtttgtacagacgcatagaccaacaggggagtttatgtttgaatttgatgaagatgagatgttctatgtggatctggacaagaaggagaccgtctggcat

SEQ ID NO: 790 - DNA, 199 bp, Homo sapiens
tttttattctttctgccaggtacatcagatccatcaggtccgagctgtgttgactaccactgcttttcccttcgtctcagttatgtcttggaagaaggktttgcggatccccggagaccttcgggtagcaactgtcaccttgatgctggcgatgctgagctccctactggctgagggcagagactctcccgaggatttc

SEQ ID NO: 791 - DNA, 201 bp, Homo sapiens
agccctctcccagagactacagagaacgtggtgtgtgccctgggcctgactgtgggtctggtgggcatcattattgggaccatcttcatcatcaagggatkgcgcaaaagcaatgcagcagaacgcagggggcctctgtaaggcacatggaggtgatggtgtttcttagagagaagatcactgaagaaacttctgctttaa

SEQ ID NO: 792 - DNA, 201 bp, Homo sapiens
gcaaaagcaatgcagcagaacgcagggggcctctgtaaggcacatggaggtgatggtgtttcttagagagaagatcactgaagaaacttctgctttaatgrctttacaaagctggcaatattacaatccttgacctcagtgaaagcagtcatcttcagcattttccagccctatagccaccccaagtgtggatatgcctct

SEQ ID NO: 793 - DNA, 201 bp, Homo sapiens
ttcttagagagaagatcactgaagaaacttctgctttaatggctttacaaagctggcaatattacaatccttgacctcagtgaaagcagtcatcttcagcrttttccagccctatagccaccccaagtgtggatatgcctcttcgattgctccgtactctaacatctagctggcttccctgtctattgccttttcctgtat

SEQ ID NO: 794 - DNA, 201 bp, Homo sapiens
aaagtgagcccggatcctcctgggagctgctccaggcatgtgggaagctgaagcggcagctctgcgccatctaccggctgaactttctgaccacagccccsagcaggggaggcccacacctgccccagcacctgcaggaccaagtgcagaggctcatgcgggagaagctgacggactggaaggacttcttgctggtgaaga

SEQ ID NO: 795 - DNA, 201 bp, Homo sapiens
gcaaggggccgctggctgcctttgtcaaaactaaggtctggtctctgatccagctggcgcgcagatacctgcagaagggctacaccacgctgctgttccargagggggatttctactgctcctacttcctgtggttcgagaatgacatggggtacaaactccagatgatcgaggtgcccgtcctctccgacgactcagtgc

SEQ ID NO: 796 - DNA, 168 bp, Homo sapiens
ctcattgaactcgcctgcagctcttgggttttttgtggcttccttcgttattggagccaggcctacaycccagcaaccatgtccaagggacctgcagttggtattgatcttggcaccacctactcttgtgtgggtgttttccagcacggaaaagtcgagataattgcc

SEQ ID NO: 797 - DNA, 168 bp, Homo sapiens; identical to SEQ ID NO: 796

SEQ ID NO: 798 - DNA, 201 bp, Homo sapiens
cgagcccacagcagcgctgggcagcaggtggccagggctgtgctccacgtgcatgggggcggtgggcccagagtccaagtgagcccagagaggacccaggrccacgcaggccgcaccgtcaggctgtactgcagggctgcaggcgtgcctagcgccaccatcacctggaggaaggaagggggcagcctcccaccacaggcc

SEQ ID NO: 799 - DNA, 201 bp, Homo sapiens
tggtgcccgggcaggcccatgcccaggtcacgtggtacaagcgcgggggcagcctccccgcccggcaccagacccatggctcccagctgcggctccacctwgtctcccctgccgactcaggcgagtatgtgtgtcgtgcagccagcggcccaggccctgagcaagaagcctccttcacagtcaccgtcccgcccagtgagg

SEQ ID NO: 800 - DNA, 201 bp, Homo sapiens
ctgcgggagggccgcagaggttccatccaagtcgacggtgaggagctggtcagcggccggtccccaggtcccaacgtggcagtcaacgccaagggcagcgrctacatcggcggagcccctgacgtggccacgctgaccgggggcagattctcctcaggcatcacaggctgtgtcaagaacctggtgctgcactcggcccga

SEQ ID NO: 801 - DNA, 201 bp, Homo sapiens
actttcccactgcccatcggggaatcagtgactgtcactcgagatcttgagggcacctacctctgtcgggccaggagcactcaaggggaggtcacccgcarggtgaccgtgaatgtgctctccccccggtatgagattgtcatcatcactgtggtagcagccgcagtcataatgggcactgcaggcctcagcacgtacctc

SEQ ID NO: 802 - DNA, 201 bp, Homo sapiens
actttcccactgcccatcggggaatcagtgactgtcactcgagatcttgagggcacctacctctgtcgggccaggagcactcaaggggaggtcacccgcargccccccggtatgagattgtcatcatcactgtggtagcagccgcagtcataatgggcactgcaggcctcagcacgtacctctataaccgccagcggaaga

SEQ ID NO: 803 - DNA, 201 bp, Homo sapiens
aggcgccgacagccgaggagacctccgcctgctgtgccccgcgccccgccaaagtcagccgcaaacgacgcagcagcagcctgagcgacggcggggacgcyggactggtcccgagcaagaaagcccgtctggaagaaaaggaagaagaggagggagcgtcatccgaagtcgccgatcgcctgcagccccctccggcgcaag

SEQ ID NO: 804 - DNA, 201 bp, Homo sapiens
gagctaccgcgagcaagtcaagatcgagagagactcccgtgagcacgaggagcccaccacctctgagatggccgaggagacctactcccccaagatcttcyggcccaaacacacccgcatctccgagctgaaggctgaagcagtgaagaaggaccgcagaaagaagctgacccagtccaagtttgtcgggggagccgagaa

SEQ ID NO: 805 - DNA, 201 bp, Homo sapiens
taattaaatatgcagaccagaaggctctatacacaagagatggccagctgctggtgggagatcctgttgcagacaactgctgtgcagagaagatctgcatycttcctaacagaggcttggcccgcaccaaggtccccattttcctggggatccagggagggagccgctgcctggcatgtgtggagacagaagaggggcctt

SEQ ID NO: 806 - DNA, 201 bp, Homo sapiens
aggctctatacacaagagatggccagctgctggtgggagatcctgttgcagacaactgctgtgcagagaagatctgcatacttcctaacagaggcttggcmcgcaccaaggtccccattttcctggggatccagggagggagccgctgcctggcatgtgtggagacagaagaggggccttccctacagctggaggatgtga

SEQ ID NO: 807 - DNA, 201 bp, Homo sapiens; identical to SEQ ID NO: 805

SEQ ID NO: 808 - DNA, 201 bp, Homo sapiens; identical to SEQ ID NO: 806

SEQ ID NO: 809 - DNA, 201 bp, Homo sapiens
ctgccgaccctctgggagaaaatccagcaagatgcaagccttcagaatctgggatgttaaccagaagaccttctatctgaggaacaaccaactagttgctygatacttgcaaggaccaaatgtcaatttagaagaaaagatagatgtggtacccattgagcctcatgctctgttcttgggaatccatggagggaagatgtg

SEQ ID NO: 810 - DNA, 201 bp, Homo sapiens; identical to SEQ ID NO: 809

SEQ ID NO: 811 - DNA, 201 bp, Homo sapiens; identical to SEQ ID NO: 809

SEQ ID NO: 812 - DNA, 201 bp, Homo sapiens; identical to SEQ ID NO: 809

SEQ ID NO: 813 - DNA, 201 bp, Homo sapiens
gatacccactgattttcagtcgggtgaaaaaatcagttgaagtactaaagaacaacaagtgtccatatttttcctgtgaacagccatgcaaccaaaccacygcaggcaacgcgctgacatttctgaagagtcttctggaaattttccagaaagaaaagatgagagggatgagaggcaagatatgaagatgaaatattattt

SEQ ID NO: 814 - DNA, 201 bp, Homo sapiens
aactgcttcctgtagtaatgttacctgctggttgaaagacgttcacatgaaaggagaatactttgttaatgtgactaccagaatttggaacgggactttcycatcatcaacgttccagacagtacagctaacggcagctgcagaaatcaacacctataaccctgagatatatgtgattgaagataacactgttacgattcc

SEQ ID NO: 815 - DNA, 201 bp, Homo sapiens
aatagataagtcttttttcaaatgtggtgtttgatgtttttgattaaatgtgttttgcctctttccacaaaaactgtaaaaataaatgcatgtttgtacamaaagttgcagaattcatttgatttatgagaaacaaaaattaaattgtagtcaacagttagtagtttttctcatatccaagtataacaaacagaaaagttt

SEQ ID NO: 816 - DNA, 201 bp, Homo sapiens
caaatgatgaaaatgagcctgaaacgtgcatggtggagaaaatgaacttaactttccatgttatcaacactggcaatagtatggctcccaatgttagtgtygaaataatggtaccaaattcttttagcccccaaactgataagctgttcaacattttggatgtccagactactactggagaatgccactttgaaaattatc

SEQ ID NO: 817 - DNA, 201 bp, Homo sapiens
ttctccgctggaaaaagggacaaaagattgcccaaaagaatcagactgtttttgaaaggaattgccgttcagaggactgtgccgcagacctgcagcttcarggtaaactgctgctctccagtatggatgagaaaaccctgtatctagctttgggggctgtgaagaacatctccctaaacatctctatctccaacctcggag

SEQ ID NO: 818 - DNA, 201 bp, Homo sapiens
ccatcaacatcacagcgcctcagtgtcacgacggacagcagcctgtgaactgcctgaacgtcaccacctgcttcagcttccatggcaaacacgttccaggrgagattggcctgaattatgttctgatggctgacgtggccaaaaaggagaagggccagatgcccagggtctactttgtgctgctgggagagaccatgggtc

SEQ ID NO: 819 - DNA, 201 bp, Homo sapiens
tcatctgctcatgtttcagtcgtttggcagctagaggagaatgcctttccaaacaggacagcagacatcactgtgactgtcaccaattccaatgaaagacygtctttggccaacgagacccacacccttcaattcaggcatggcttcgttgcagttctgtccaaaccatccataatgtacgtgaacacaggccaggggctt

SEQ ID NO: 820 - DNA, 201 bp, Homo sapiens
gagggcccaacatctgtaccacgcgaggtgtgagctcctgccagcagtgcctggctgtgagccccatgtgtgcctggtgctctgatgaggccctgcctctyggctcacctcgctgtgacctgaaggagaatctgctgaaggataactgtgccccagaatccatcgagttcccagtgagtgaggcccgagtactagaggaca

SEQ ID NO: 821 - DNA, 201 bp, Homo sapiens
tcgggctacgcaaggatttggccagtgctatccttgacctgccagtcctggagcacctctttgcccagcaccgcagtgacctggtgagtgggcgcctcccsgtgggcctcagtctcaaggagcagggtgagtgtctcagcctggccgtgttggacctggcccggatggcgcgagagcaggcccagcggccgggagagctgc

SEQ ID NO: 822 - DNA, 201 bp, Homo sapiens
tacatcctggtcacgactgtgctgcccctctaccagaaaagcgtgtggacccaggaatccaagtgccacctgattgagaccaacatcagggaccaggaggrgctgaagggcaagaaggtgccccagtacccatgcctgtgggtcaacgtgtcagctgccggcaggtgggctgtgctgtaccacacggaggacactcgggac

SEQ ID NO: 823 - DNA, 201 bp, Homo sapiens
aataacaagaccaagtaagaatgtttcaacaatgcgttggcaagagatgtgagatgacaacaggaacatacaagatactgtgaatctagatgttctgaccyaaagatgtagtctacatagccccagcttggggtccaatccatctgtccctggcatgtgccttcatgtagtaggtgctttcctgatcccctttgcgagatg

SEQ ID NO: 824 - DNA, 201 bp, Homo sapiens
tcttcgaagcatcagcataagaaacttgtaaaccgagacctaaaaacccagtctgggagtgagatgaagaaatttttgagcaccttaactatagatggtgraacccggagtgaccaaggattgtacacctgtgcagcatccagtgggctgatgaccaagaagaacagcacatttgtcagggtccatgaaaaaccttttgtt

SEQ ID NO: 825 - DNA, 201 bp, Homo sapiens; identical to SEQ ID NO: 824

SEQ ID NO: 826 - DNA, 201 bp, Homo sapiens; identical to SEQ ID NO: 824

SEQ ID NO: 827 - DNA, 201 bp, Homo sapiens
caggtagcccatttcctgtgacgagaatgtcttcaagatcaagtgacgcaaaaccactgcccgcgtcctatccagctgaacctagggagccccaggaaagsccgaaaatcaccagtgctttcagctctgtgaaaccaagtgaagcggtccctcggaagtttgacagtggtggagagaggggggcagggctcccactgtccc

SEQ ID NO: 828 - DNA, 201 bp, Homo sapiens
tactgaatctgagaaaaagttcatcaaaggaactgctgacttttttgctctttgctttggacccaccttgagttttcaacttttggaccctcacatgaagrtccgccaattggaatctcccaacctgaggcaactgctttcctggattgaccttgaatttaaccatcctcaaatatttattgtggaaaatggctggtttgt

SEQ ID NO: 829 - DNA, 201 bp, Homo sapiens
atcccgagagcatgaagaataacctttcatctattctgcctgattttactgaatctgagaaaaagttcatcaaaggaactgctgacttttttgctctttgstttggacccaccttgagttttcaacttttggaccctcacatgaagttccgccaattggaatctcccaacctgaggcaactgctttcctggattgaccttg

SEQ ID NO: 830 - DNA, 201 bp, Homo sapiens
tctctggactttgtactaggttggtttgccaaacccgtatttattgatggtgactatcccgagagcatgaagaataacctttcatctattctgcctgattktactgaatctgagaaaaagttcatcaaaggaactgctgacttttttgctctttgctttggacccaccttgagttttcaacttttggaccctcacatgaag

SEQ ID NO: 831 - DNA, 201 bp, Homo sapiens
gggcgtctctggccgagcctctttttgtggaaaacgacagcagcagcagtggcctggaagacgccaccgctaactgaccccgacctggccccgctccaggrtgggactgccgagtgtggcccggagctggcccgggacagccagggcggcagggagggcccctggccgggagccgcagcgctcactcatttctcctgcgtc

SEQ ID NO: 832 - DNA, 201 bp, Homo sapiens
tgtttggcttccggctggggcagcatcgaaccagagaatttctcatttccagatgatctccagtgtgtggacctcaaaatcctgcctaatgatgagtgcaraaaagcccacgtccagaaggtgacagacttcatgctgtgtgtcggacacctggaaggtggcaaagacacctgtgtgggtgattcagggggcccgctgatg

SEQ ID NO: 833 - DNA, 201 bp, Homo sapiens
caagcagacgaggactacagccacgacctcatgctgctccgcctgacagagcctgctgataccatcacagatgctgtgaaggtcgtggagttgcccaccgsggaacccgaagtggggagcacctgtttggcttccggctggggcagcatcgaaccagagaatttctcatttccagatgatctccagtgtgtggacctcaaa

SEQ ID NO: 834 - DNA, 201 bp, Homo sapiens
ctggcgaagctgctgccgctgctgatggcgcaactctgggccgcagaggcggcgctgctcccccaaaacgacacgcgcttggaccccgaagcctatggctkcccgtgcgcgcgcggctcgcagccctggcaggtctcgctcttcaacggcctctcgttccactgcgcgggtgtcctggtggaccagagttgggtgctgacg

SEQ ID NO: 835 - DNA, 201 bp, Homo sapiens; identical to SEQ ID NO: 834

SEQ ID NO: 836 - DNA, 201 bp, Homo sapiens; identical to SEQ ID NO: 834

SEQ ID NO: 837 - DNA, 201 bp, Homo sapiens
ccctcagcccctaaaatgttcctcctgctgacagcacttcaagtcctggctatagccatgacacagagccaagaggatgagaacaagataattggtggccytacgtgcacccggagctcccagccgtggcaggcggccctgctggcgggtcccaggcgccgcttcctctgcggaggcgccctgctttcaggccagtgggtc

SEQ ID NO: 838 - DNA, 201 bp, Homo sapiens
tgcaccccactcccagccatggcaagtggctctctacgagcgtggacgctttaactgtggcgcttccctcatctccccacactgggtgctgtctgcggccmactgccaaagccgcttcatgagagtgcgcctgggagagcacaacctgcgcaagcgcgatggcccagagcaactacggaccacgtctcgggtcattccaca

SEQ ID NO: 839 - DNA, 201 bp, Homo sapiens; identical to SEQ ID NO: 838

SEQ ID NO: 840 - DNA, 201 bp, Homo sapiens; identical to SEQ ID NO: 838

SEQ ID NO: 841 - DNA, 201 bp, Homo sapiens
cgcgcaacactgtgtcccgcgaggagctcatgatggtgctggccagcctggagcagctgcagatccgtgccctcttctcacagatctcctcggctgtcttyctgcgcagggtggcactggaggtggccagcccagcaggccagggggccctggccagcaatgtggagctgtgcctgtgccccgccagctaccggggggact

SEQ ID NO: 842 - DNA, 201 bp, Homo sapiens
gccacggtgtacagcgtggagcaggacaatgatctggagctggccgacgcctactacctggggggcgtgccgcccgaccagctgcccccgagcctgcgacygctcttccccaccggaggctcagtccgtggctgcgtcaaaggcatcaaggccctgggcaagtatgtggacctcaagcggctgaacacgacaggcgtgagc

SEQ ID NO: 843 - DNA, 162 bp, Homo sapiens
gggacagtcctggcccactgcactgggaatctaggatgggggccttggccagagccctgccytccatactgctggcattgctgcttacgtccaccccagaggctctgggtgccaaccccggcttggtcgccaggatcaccgacaagggactgcagtatgcgg

SEQ ID NO: 844 - DNA, 201 bp, Homo sapiens
agcagcccaggaggcgaggaaggctgggcgagctctagccctaagggagtgccgttcctgcccctgccctgagaaggagccccagacttaccgatgtagaygctgcccttggcgttgactgccacgttgggacctggggaccggccgctgaccagctcctcaccgtcgacttggatggaacctctgcggccctccctgcag

SEQ ID NO: 845 - DNA, 201 bp, Homo sapiens
cttagaggctttttaagaggatatttgttttactttggaaaaggagaaagagacacatctaagatgagggttttagaatcaggtcgttctgacataaaagrtaagaatattactgacatatcccagaagacactgagaattgctgatcttcaaggtaaaacaagttaccacctggtcttgcgagcctatacagatggtgga

SEQ ID NO: 846 - DNA, 201 bp, Homo sapiens
ccctaattctcattcttttttgggggttgcaggggagttcactgtgctgtttgctatatttcaagcctcaaaagacaatgaagttcccaaatgctcttcawggcagaacaaatataaataatgattctcacaccaaatgtgtgcaaagttcaaatattgcattaatggtgctttttattgtgcaaatcatacgactaaccc

SEQ ID NO: 847 - DNA, 201 bp, Homo sapiens
acaagggcaactttttctcagccaggaggagggtgccctgtggcatcattacaagtgtcctggcatgggtaacagccattctggccactttgcctgaatawgtggtttataaacctcagatggaagaccagaaatacaagtgtgcatttagcagaactcccttcctgccagctgatgagacattctggaagcattttctga

SEQ ID NO: 848 - DNA, 201 bp, Homo sapiens
tgctgctcactgcttgaagaagtcctcaaggccttcatcctacaaggtcatcctgggtgcacaccaagaagtgaacctcgaatctcatgttcaggaaataraagtgtctaggctgttcttggagcccacacaagcagatattgccttgctaaagctaagcaggcctgccgtcatcactgacaaagtaatgccagcttgtct

SEQ ID NO: 849 - DNA, 201 bp, Homo sapiens
cccagtgtcagatgggagtactgcaacctgacgcaatgtccagtgatggaatcaactctcctcacaactcccacggtggtcccagttccaagcacagagcstccttctgaagaagcaccaactgaaaacagcactggggtccaggactgctaccgaggtgatggacagagttatcgaggcacactctccaccactatcaca

SEQ ID NO: 850 - DNA, 201 bp, Homo sapiens
aatccagatgctgagattcgcccttggtgttataccatggatcccagtgtcagatgggagtactgcaacctgacgcaatgtccagtgatggaatcaactcscctcacaactcccacggtggtcccagttccaagcacagagcttccttctgaagaagcaccaactgaaaacagcactggggtccaggactgctaccgaggt

SEQ ID NO: 851 - DNA, 201 bp, Homo sapiens; identical to SEQ ID NO: 848

SEQ ID NO: 852 - DNA, 201 bp, Homo sapiens; identical to SEQ ID NO: 849

SEQ ID NO: 853 - DNA, 201 bp, Homo sapiens; identical to SEQ ID NO: 850

SEQ ID NO: 854 - DNA, 201 bp, Homo sapiens
ataaccgctcctgcaaggccaagaacgagccagtagaccggccccctgtgctgttgatagccaactcccagaacatcttggccacgtacctgagtggggcycaggtgtctaccatcacacctacgagcacgcggcagaccacagccatggacttcagctatgccaacgagaccgtatgctgggtgcatgttggggacagtg

SEQ ID NO: 855 - DNA, 201 bp, Homo sapiens
ccaaagactgttcagatgacgcggatgaaattggctgcgctgttgtgacctgccagcagggctatttcaagtgccagagtgagggacaatgcatccccaartcctgggtgtgtgaccaagatcaagactgtgatgatggctcagatgaacgtcaagattgctcacaaagtacatgctcaagtcatcagataacatgctcca

SEQ ID NO: 856 - DNA, 201 bp, Homo sapiens
ttctgctgcctggggcccaggggctccctggtgttggcctcacaccttcagctgcccagactgcccgtcagcaccccaagatgcatcttgcccacagcacmctcaaacctgctgctcacctcattggagaccccagcaagcagaactcactgctctggagagcaaacacggaccgtgccttcctccaggatggtttctcct

SEQ ID NO: 857 - DNA, 201 bp, Homo sapiens
ctgcattctgttagagcacaaggtggtgctacagtcccgagactacaatgcactctccatgtctgtgatggcattcgtggcaatgatctacccactggagratatgtttcctgtcatcccgctgctacccacctgcatggcatcagcagagcagctgctgttggctccaaccccgtacatcattggggttcctgccagctt

SEQ ID NO: 858 - DNA, 201 bp, Homo sapiens
ctgcattctgttagagcacaaggtggtgctacagtcccgagactacaatgcactctccatgtctgtgatggcattcgtggcaatgatctacccactggaaratatgtttcctgtcatcccgctgctacccacctgcatggcatcagcagagcagctgctgttggctccaaccccgtacatcattggggttcctgccagctt

SEQ ID NO: 859 - DNA, 126 bp, Homo sapiens
cacgtgcatgtgtagcatgccttggkttttcctttggcatctgaaaaaggcacaacctgaaagacctagaacccagtgtcggtccccaggccctttgggacaggaagagaagagccgtgtggccgc

SEQ ID NO: 860 - DNA, 201 bp, Homo sapiens; identical to SEQ ID NO: 857

SEQ ID NO: 861 - DNA, 201 bp, Homo sapiens; identical to SEQ ID NO: 857

SEQ ID NO: 862 - DNA, 201 bp, Homo sapiens; identical to SEQ ID NO: 857

SEQ ID NO: 863 - DNA, 201 bp, Homo sapiens; identical to SEQ ID NO: 857

SEQ ID NO: 864 - DNA, 201 bp, Homo sapiens; identical to SEQ ID NO: 858

SEQ ID NO: 865 - DNA, 201 bp, Homo sapiens; identical to SEQ ID NO: 858

SEQ ID NO: 866 - DNA, 201 bp, Homo sapiens
tgataactgggaaatggcctatacagagaagggcgaagtctacttcattgaccataacacaaagacaacatcatggctggatccacgacttgcgaaaaagrctaaacctccagaagagtgcaaagaaaatgagcttccatatggctgggaaaaaatcgatgatcccatttatggcacttattatgttgaccacataaatag

SEQ ID NO: 867 - DNA, 201 bp, Homo sapiens
cggcggcggcggggcagttgcagtggtgcagaatggctgacctcagtcttgcagatgcattaacagaaccatctccagacattgagggagagataaagcgrgacttcattgccacactagaggcagaggcctttgatgatgttgtgggagaaactgttggaaaaacagactatattcctctcctggatgttgatgagaaaa

SEQ ID NO: 868 - DNA, 201 bp, Homo sapiens; identical to SEQ ID NO: 867

SEQ ID NO: 869 - DNA, 201 bp, Homo sapiens
gcctgcgaaataccttgatgaggatacaatctaccacctacagccaagtggcagatttgttattggtgggcctcagggtgatgctggtttgactggacgcsaaatcattgtggacacttatggcggttggggtgctcatggaggaggtgccttttcaggaaaggattataccaaggtcgaccgttcagctgcttatgctgc

SEQ ID NO: 870 - DNA, 201 bp, Homo sapiens
tgcacacagctgctggtggcaccgtgcacctggagatcggcctgctgctccgcaacttcgaccgctacggcgtggagtgctgagggactctgcctccaacrtcaccaccatccacaccccggacacccagtgatgggggaggatggcacagtggtcaagagcacagactctagagactgtcagagctgaccccagctaagg

SEQ ID NO: 871 - DNA, 201 bp, Homo sapiens
caagcccatgaactacaaccccggttgccgctttctcctctcctaaccgttaagtgcgctaagggccatggctgaggtgcacgtgatcgggcagatcatgrgggccagcggtttctcggaaagtagcctcttctgcaagtggggcattcacacaggggcggcatggaagctcctgtcaggcgtgcgggagggccaaacgca

SEQ ID NO: 872 - DNA, 201 bp, Homo sapiens
agactccatgtgcctgagatcaagaaagacaaaaagccagcctgcagcaagcactttggagagcaaatctgtgcagagagtaacgcggagtgtcaagaggrgtgcagaaaatccaaagaaggctgaggacaatgtgtgtgtcaagaaaataagaaccagaagtcatagggacagtgaagatatttgacagaaaaatcgaac

SEQ ID NO: 873 - DNA, 201 bp, Homo sapiens
ctaaggaaaaggcccaggctctagaagacctggctggctttaaagagctcttccagactcctggtcacaccgaggaattagtggctgctggtaaaaccacyaaaataccctgcgactctccacagtcagacccagtggacaccccaacaagcacaaagcaacgacccaagagaagtatcaggaaagcagatgtagagggag

SEQ ID NO: 874 - DNA, 201 bp, Homo sapiens
aggcaggtggccgccgccggagcaatggtgcaaacagctcttctccagtgtggtccccgtgctgctgggggacccagaggaggagccgggtgggcggcagstcctggacctcaattgctttttgtccgacatctcagacactctcttcaccatgactcagtccggcccttcgcccctgcagctgccgcctgaggatgccta

SEQ ID NO: 875 - DNA, 201 bp, Homo sapiens; identical to SEQ ID NO: 874

SEQ ID NO: 876 - DNA, 201 bp, Homo sapiens; identical to SEQ ID NO: 874

SEQ ID NO: 877 - DNA, 201 bp, Homo sapiens; identical to SEQ ID NO: 874

SEQ ID NO: 878 - DNA, 201 bp, Homo sapiens
ggctccctggcccgaatcttcacttccattcaggaaaccggagatcccctgatggctgggacctttgtggtctcctctctctgcaacggcctcatcgccgrccagctgctcttctactggaatgcaaagcctccccacaagcagaaaaaggcgcagtagagccagctactggagtcattccgtttccactcattcacccaa

SEQ ID NO: 879 - DNA, 201 bp, Homo sapiens
tcccagagcatgccccactttggaacccgatacgtgtgccagtttccagaccaggaggaagtgcgtctcttctttccgctgcacctctgggtgaagaatgrgttcctaaaccagactcggactcagcgagtcctctttgtggacagtgtaggcctgccggctccccccagtatcatcaaggccatgggtgggagccagcca

SEQ ID NO: 880 - DNA, 201 bp, Homo sapiens; identical to SEQ ID NO: 879

SEQ ID NO: 881 - DNA, 201 bp, Homo sapiens; identical to SEQ ID NO: 879

SEQ ID NO: 882 - DNA, 200 bp, Homo sapiens
atgaggaaaggcctggggcagaagagcccaactccttctcatagctgaccctcatcctcctgccttggcctcctggctgctttctccccttccccccagcrtggcaggatctcttcctgttagcaaggatgaaagagagaggtcagtaggactggaacttggtaactgcaagggcctcaggtggggcaggtgcagagggc

SEQ ID NO: 883 - DNA, 201 bp, Homo sapiens
gttgtgcagtttcactgttacatgccttgaagtgatgaggaggtttctgttactatatgctacacagcagggacaggcaaaggccatcgcagaagaaatargtgagcaagctgtggtacatggattttctgcagatcttcactgtattagtgaatccgataagtatgacctaaaaaccgaaacagctcctcttgttgttgt

SEQ ID NO: 884 - DNA, 201 bp, Homo sapiens
gcggcgtggtttcactgttacatgccttgaagtgatgaggaggtttctgttactatatgctacacagcagggacaggcaaaggccatcgcagaagaaatargtgagcaagctgtggtacatggattttctgcagatcttcactgtattagtgaatccgataagtatgacctaaaaaccgaaacagctcctcttgttgttgt

SEQ ID NO: 885 - DNA, 201 bp, Homo sapiens
tgacaagccaagtcctccccaggatctccgggtgactgacgcctggggtcttaatgtggctctggagtggaagccaccccaggatgtcggcaacacggagrtctgggggtacacagtgcagaaagccgacaagaagaccatggagtggttcaccgtcttggagcattaccgccgcacccactgcgtggtgccagagctcat

SEQ ID NO: 886 - DNA, 201 bp, Homo sapiens; identical to SEQ ID NO: 885

SEQ ID NO: 887 - DNA, 201 bp, Homo sapiens; identical to SEQ ID NO: 885

SEQ ID NO: 888 - DNA, 201 bp, Homo sapiens
gagacaaatgcatcagcaacagcaagttcagcaacgaactttgatgatgagaggacaagggttgaatatgacaccaagcatggtggctcctagtggtatgscagcaactatgagcaaccctcggattccccaggcaaatgcacagcagtttccatttcctccaaactacggaataagtcagcaacctgatccaggctttac

SEQ ID NO: 889 - DNA, 201 bp, Homo sapiens
ttttaagctaaagcctgaatttgggatggaagcaggacagacaccgtggacagcgctgtatttacagacacacccagtgcgtgaagaccaacaaagtcacrgtcgtatctctagaaagctctaaagaccatgttggaaagagtctccagttactgaacagatgaaaaggagcctgtgagagggctgttaacattagcaaat

SEQ ID NO: 890 - DNA, 201 bp, Homo sapiens
gccttgggtgatcaccagagcttgaggtggctcagcctggtggggaacaacattggcagtgtgggtgcccaagccttggcactgatgctggcaaagaacgrcatgctagaagaactctgcctggaggagaaccatctccaggatgaaggtgtatgttctctcgcagaaggactgaagaaaaattcaagtttgaaaatcctg

SEQ ID NO: 891 - DNA, 201 bp, Homo sapiens
agccaacgtggagatcaccgagctctgcattcagcacggctggaccccaggaaacggtcgcttcgacgtgctgcccctgctgctgcaggccccagatgatkccccagaactcttccttctgccccccgagctggtccttgaggtgcccctggagcaccccacgctggagtggtttgcagccctgggcctgcgctggtacgc

SEQ ID NO: 892 - DNA, 201 bp, Homo sapiens
acgcctgtaatgccaccaactggattgaatacatgttcaataaggacaatggacaggcaccttttaccatcactcctgtgttttcagattttccagtccargggatggagcccatgaacaatgccaccaaaggctgtgacgagtctgtggatgaggtcacagcaccatgtagctgccaagactgctctattgtctgtggcc

SEQ ID NO: 893 - DNA, 201 bp, Homo sapiens
tattctccacttctgctaaaggactggatgagaccaattgtgatagcaatatttgtgggtgttctgtcattcagcatcgcagtcctgaacaaagtagatartggattggatcagtctctttcgatgccagatgactcctacatggtggattatttcaaatccatcagtcagtacctgcatgcgggtccgcctgtgtacttt

SEQ ID NO: 894 - DNA, 201 bp, Homo sapiens
tagcagaacctgctatatcaggaggacagcagcaactagcttttgatccccaactaggcacagctcctgaaattgctgtgatgtcaacaggagaagagatyccatatttacaaaaagaagcgatcaactttagacatgacagtgcaggagttttcatgccctcaacttcaccaaaacccagcacaaccaatgttttcactt

SEQ ID NO: 895 - DNA, 201 bp, Homo sapiens
ttcttgttcacatggtctctgggagctgagatggttctcttcaccaccatggcctatgaccgctatgtggccatttgtttccctcttcattacagtactartatgaaccaccatatgtgtgtagccttgctcagcatggtcatggctattgcagtcaccaattcctgggtgcacacagctcttatcatgaggttgactttc

SEQ ID NO: 896 - DNA, 201 bp, Homo sapiens
gcctcaccaaaaagcctgaactccagggaattatcttcctcttttttctcattgtctatcttgtggcttttctcggcaacatgctcatcatcattgccaawatctataacaacaccttgcatacgcccatgtatgttttccttctgacactggctgttgtggacatcatctgcacaacaagcatcataccgaagatgctgg

SEQ ID NO: 897 - DNA, 201 bp, Homo sapiens
gaggttccacctgctttccagcacattcttggtttcctcacttctgctagacaacgtttgatcagaaggaacagggaacgagaaggagctgctggatgacrataagcctgggaaagggaggctgggtgagcagagacagaaaagaaacacctacctgctgtgacctcacaaacacccaggctgagttttgataagacaggt

SEQ ID NO: 898 - DNA, 201 bp, Homo sapiens
accaaaggaaaatgtcagcaggaaaccattcctcagtgactgagttcattctggctgggctctcagaacagccagagctccagctgcgcctcttcctcctyttcttaggaatctatgtggtcacagtggtgggcaacttgagcatgatcacactgattgggctcagttctcacctgcatacccccatgtactatttcctca

SEQ ID NO: 899 - DNA, 201 bp, Homo sapiens
cggggccggcagggcccagtgagcgacgagagctcctaccaaccctccaggcagtggcgctaccgggaggcctctaggaaggcggaggccatagggaagcsgaaagtgcagggcgaggtctctctggaaaaggaaggctcctcccagggctgagggccagctgcagggctgcagcgctgtgggggtaagggctgccgcgct

SEQ ID NO: 900 - DNA, 201 bp, Homo sapiens
ccaatgccttggagacctgggaccccacctattttaagcactgccgctatgaaccacaattcagcccctactgtcccgtgttccgcattggggacctcgtrgccaaggctggagggaccttcgaggacctggcgttgctgggtggctctgtaggcatcagagttcactgggattgtgacctggacaccggggactctggct

SEQ ID NO: 901 - DNA, 201 bp, Homo sapiens
gctgccagagaggggagacctacagccctgccgagcagagctgcgtgcacttcgcatgtgagaaaactgactgtccagagctggctgtggagaatgcttcmctcaattgctccagcagcgaccgctaccacggtgcccagtgtactgtgagctgccggacaggctacgtgctccagatacggcgggatgatgagctgatca

SEQ ID NO: 902 - DNA, 201 bp, Homo sapiens
aatccgctctactggaatgtggttgcacgatgggaacacaagacccgcaagctgagcagggccttcggatccccctacctggcctgctactctctaagcgrcaccatcctgctcctgaacttcctgcgctcgcactgcttcacgcaggccatgctgagccagcccaggatggagagcctggacacccccgcggcctacagc

SEQ ID NO: 903 - DNA, 201 bp, Homo sapiens; identical to SEQ ID NO: 902

SEQ ID NO: 904 - DNA, 201 bp, Homo sapiens; identical to SEQ ID NO: 902

SEQ ID NO: 905 - DNA, 201 bp, Homo sapiens
ttgctactgtggtcagacccagggacagcctccctgcccctgctcatggactctgtcatccaggccctggctgagctggagcagaaagtgccagctgccargaccagacacacagcttctgcgtggctgatgtcagctccaaactctggcccccacaatcgcctctaccacttcctgctgggggcatggagcctcaatgct

SEQ ID NO: 906 - DNA, 201 bp, Homo sapiens
cgctggaaggtatctctaagggacagcagtctggaggctgaccacgttattagtgccattccagcttcagtgctcagtgagctgctccctgctgaggctgrccctctggctcgtgccctgagtgccatcactgcagtgtctgtagctgtggtgaatctgcagtaccaaggagcccatctgcctgtccagggatttggacat

SEQ ID NO: 907 - DNA, 201 bp, Homo sapiens
aggatcctaaattgcagcaaggctacaatgctatgggattctcccagggaggccaatttctgagggcagtggctcagagatgcccttcacctcccatgatyaatctgatctcggttgggggacaacatcaaggtgtttttggactccctcgatgcccaggagagagctctcacatctgtgacttcatccgaaaaacactga

SEQ ID NO: 908 - DNA, 201 bp, Homo sapiens
gcactcaacaggctcgctgcttaagagatactgaacagatcttcagagaaggtccggttgaaattggtctcccatgctccatcaaaaatgaagcaaggccyccatgtttaccgacaccgggaaaaagagagcctcagggcatttcctgggagtctccgttggatgaggtggataaaatgtgccatcttccagaacctgaac

SEQ ID NO: 909 - DNA, 201 bp, Homo sapiens
ttcttaagaaacggctagttgatggggagtgctcaacagcacgactccctgaaaatgcagaaagaaatcgattccaagatgttcttccttatgatgatgtyagagtggagttggtcccaactaaagaaaacaacactggttacatcaacgcatcacatattaaggtctctgtcagtggaatcgaatgggattatattgcca

SEQ ID NO: 910 - DNA, 201 bp, Homo sapiens
acagaaccatatgcttcttcccaagataacctctttgtgcccaaccagaacggatactactgtcactctcagacaagcttggatagagcccagattgaccycaacggtcggatccgtaatggcagtgtctacagtgcacacagcaccaactccttaaataatcctcagccctacttgcagccctcgccgatgtcgtccaac

SEQ ID NO: 911 - DNA, 201 bp, Homo sapiens
caacactgtcacctatggaaggtttaagatcacgacccggttccgcacagactctggctgctatgccaccacaggcctgaagatgaagcacctccttactyggcaagagaggaccgtctggcacctccaatacacagactggcctgaacatggctgtccagaagacctcaagggatttttatcatatcttgaagagatcca

SEQ ID NO: 912 - DNA, 201 bp, Homo sapiens
ctcctgcatccaggcccccaccttctcggcttctggtttttctttctttttggtagaacacaacatctaccattcagttaaaccttctttatctcctcctytggcatccatttttccaaagaagagtcgagtcctctgaggtctgtgcttgaaagccgtccgaaggcattcttgttagctttgcttttctccccatatccc

SEQ ID NO: 913 - DNA, 201 bp, Homo sapiens
ttgaggccacttttgagcaagggagatcctggagttaagacaggtgttgggggcagcctgtattttaccctaggggcaggtctgcatggtgaccccacatygcactggtaaaccatttgagtcccactcttcatcctggaagtgggaactggagtcccacccacagtgcattcagaaagcatgctgtgtgggggctgcttc

SEQ ID NO: 914 - DNA, 201 bp, Homo sapiens
agcagctactggctcaaattcaggttctggcgtcaaatagcgacatttccagtttctcttaaaaaccgtgtttggtttcagttgggataggcttgttttgkctgttgaaaatgtttctagttttttttctttcatttttctctcattccatttctgccttaactttagtttgttcacagggaggcaaagctgacatgaacc

SEQ ID NO: 915 - DNA, 201 bp, Homo sapiens
gacccccgaagcagccagctcccgagcccatcgtaggcaccgcaggcaggccgtgttcaggaggattaagactcgcaccgcgtccacacccgtcaacacarcctccagacccccgtccagtgaattcttggacctaagttcagccagtgaagatgacttcgacagtgaggacagtgagcaggagctgaaggggtacgcctg

SEQ ID NO: 916 - DNA, 201 bp, Homo sapiens; identical to SEQ ID NO: 912

SEQ ID NO: 917 - DNA, 201 bp, Homo sapiens; identical to SEQ ID NO: 913

SEQ ID NO: 918 - DNA, 201 bp, Homo sapiens; identical to SEQ ID NO: 914

SEQ ID NO: 919 - DNA, 201 bp, Homo sapiens
agacccccgaagcagccagctcccgagcccatcgtaggcaccgcaggcaggccgtgttcaggaggattaagactcgcaccgcgtccacacccgtcaacacrccctccagacccccgtccagtgaattcttggacctaagttcagccagtgaagatgacttcgacagtgaggacagtgagcaggagctgaaggggtacgcct

SEQ ID NO: 920 - DNA, 201 bp, Homo sapiens; identical to SEQ ID NO: 912

SEQ ID NO: 921 - DNA, 201 bp, Homo sapiens; identical to SEQ ID NO: 913

SEQ ID NO: 922 - DNA, 201 bp, Homo sapiens; identical to SEQ ID NO: 914

SEQ ID NO: 923 - DNA, 201 bp, Homo sapiens; identical to SEQ ID NO: 915

SEQ ID NO: 924 - DNA, 201 bp, Homo sapiens
cacattaaatacagtgtttgtcctggcagtgaaactgaagtggttttattattccacacgatatgtttatcttttggtgaggcacatgtatcgaatttacygattacagttattgatggaggacacatggaagaggattcgtttcccagacatactacgagtcttttggctaacaagagttacagctcaggctacagtgtt

SEQ ID NO: 925 - DNA, 201 bp, Homo sapiens
ccagcccggcgccgcctgctgtgcccactctgtcgccagcccacagtgctggcctcagggcagcctgtcactgacttgcccacggacactgccatgctcgrcctgctccgcctggagccccaccatgtcatcctggaaggccatcagctgtgcctcaaggaccagcccaagagccgctacttcctgcgccagcctcaagtc

SEQ ID NO: 926 - DNA, 201 bp, Homo sapiens
agtgctgggctcaagaacccgaccaaagacctacttttcatagaattcaggaccaacttcagttattcagaaattttttcttaaatagcatttataagtcsagagatgaagcaaacaacagtggagtcataaatgaaagctttgaaggtgaagatggcgatgtgatttgtttgaattcagatgacattatgccagttgctt

SEQ ID NO: 927 - DNA, 201 bp, Homo sapiens
ctggagccaccaagaaattgtcctgatgatctgtggaatttaatgacccagtgctgggctcaagaacccgaccaaagacctacttttcatagaattcaggrccaacttcagttattcagaaattttttcttaaatagcatttataagtccagagatgaagcaaacaacagtggagtcataaatgaaagctttgaaggtgaa

SEQ ID NO: 928 - DNA, 201 bp, Homo sapiens
atgtatggaaactgctatactttcaatgacaagaacaactccaacctctggatgtcttccatgcctggaatcaacaacggtctgtccctgatgctgcgcgragagcagaatgacttcattcccctgctgtccacagtgactggggcccgggtaatggtgcacgggcaggatgaacctgcctttatggatgatggtggcttt

SEQ ID NO: 929 - DNA, 201 bp, Homo sapiens
actgtaagaagctgtccagctgggtgctgctgatgaaatacctgggcaatgccaccgccatcttcttcctgcctgatgaggggaaactacagcacctggawaatgaactcacccacgatatcatcaccaagttcctggaaaatgaagacagaaggtctgccagcttacatttacccaaactgtccattactggaacctatg

SEQ ID NO: 930 - DNA, 201 bp, Homo sapiens
aggtctgccagcttacatttacccaaactgtccattactggaacctatgatctgaagagcgtcctgggtcaactgggcatcactaaggtcttcagcaatgrggctgacctctccggggtcacagaggaggcacccctgaagctctccaaggccgtgcataaggctgtgctgaccatcgacgagaaagggactgaagctgct

SEQ ID NO: 931 - DNA, 201 bp, Homo sapiens; identical to SEQ ID NO: 929

SEQ ID NO: 932 - DNA, 201 bp, Homo sapiens; identical to SEQ ID NO: 930

SEQ ID NO: 933 - DNA, 201 bp, Homo sapiens; identical to SEQ ID NO: 929

SEQ ID NO: 934 - DNA, 201 bp, Homo sapiens; identical to SEQ ID NO: 930

SEQ ID NO: 935 - DNA, 201 bp, Homo sapiens
ctggcaagcaccagggaggagaacttctatgtggacgagacaactgtggtgaaggtgcccatgatgttgcagtcgagcaccatcagttaccttcatgacgkggagctcccctgccagctggtgcagatgaactacgtgggcaatgggactgtcttcttcatccttccggacaaggggaagatgaacacagtcatcgctgca

SEQ ID NO: 936 - DNA, 201 bp, Homo sapiens
ggaaggttgtagacataatccaaggccttgaccttctgacggccatggttctggtgaaccacattttctttaaagccaagtgggagaagccctttcacccygaatatacaagaaagaacttcccattcctggtgggcgagcaggtcactgtgcatgtccccatgatgcaccagaaagagcagttcgcttttggggtggata

SEQ ID NO: 937 - DNA, 201 bp, Homo sapiens
cactccagaaaaggtggatagaggtgttcatccccagattttccatttctgcctcctacaatctggaaaccatcctcccgaagatgggcatccaaaatgtytttgacaaaaatgctgatttttctggaattgcaaagagagactccctgcaggtttctaaagcaacccacaaggctgtgctggatgtcagtgaagagggca

SEQ ID NO: 938 - DNA, 201 bp, Homo sapiens; identical to SEQ ID NO: 936

SEQ ID NO: 939 - DNA, 201 bp, Homo sapiens; identical to SEQ ID NO: 937

SEQ ID NO: 940 - DNA, 201 bp, Homo sapiens
cctcggccacgctccgctttgcagccataactttgacacaagctggggcctatcattgccaagcccaggccccaggctcagccaccacgagcctagctgcycccatcagcctccacgtgtcctatgccccacgccacgtcacactcactaccctgatggacacaggccctggacgactgggcctcctcctgtgccgtgtgg

SEQ ID NO: 941 - DNA, 201 bp, Homo sapiens
agccagaagtttgagcccaccggcgtcggccacctggagaccctccacatggccatgtcctggcaggaccacggccggatcctgcgctgccagctctccgrggccaatcacagggctcagagcgagattcacctccaagtgaagtatgcccccaagggtgtgaagatcctcctcagcccctcggggaggaacatccttcca

SEQ ID NO: 942 - DNA, 201 bp, Homo sapiens
tggtcccaactccctgcgcctggagatccgagacctggaggaaactgacagtggggagtacaagtgctcagccaccaactcccttggaaatgcaacctccyccctggacttccatgccaatgccgcccgtctcctcatcagcccggcagccgaggtggtggaaggacaggcagtgacactgagctgcagaagcggcctaag

SEQ ID NO: 943 - DNA, 201 bp, Homo sapiens
acggttgcttttgaaacggggatgcagaacacgcagctatgttccaccatcgttcagctctccttcactcctgaggagctcaatgtcgtattcaccttccygctcatctacagcattttccagctcgcctttgccgcaatattcttaggattttatgtggcatacaagaaatgtcatggaaaaaacaaggcagaaattcca

SEQ ID NO: 944 - DNA, 201 bp, Homo sapiens
ttgtgtcgctctccattgtctacacaattggacaagcagtcacctcagtaagctccattaatgacctcacagaccacaaccatgatggcacccccgacagrcttcctgtgcacgtggtgctgtccttgatcggcctggccctgatagctctcgggactggaggaatcaaaccctgtgtgtctgcgtttggtggagatcagt

SEQ ID NO: 945 - DNA, 201 bp, Homo sapiens; identical to SEQ ID NO: 944

SEQ ID NO: 946 - DNA, 201 bp, Homo sapiens; identical to SEQ ID NO: 944

SEQ ID NO: 947 - DNA, 201 bp, Homo sapiens
tgaatgacactgccagcaccatcccacctccagccactgaagccatctcagctcataaaaacaactgcttgcaaggcacaggtttcttggaggaagagacyacccgggtcggggttctgtttgcttcaaaggctgtgatgcaacttctggtcaacccattcgtgggccctctcaccaacaggattggatatcatatcccca

SEQ ID NO: 948 - DNA, 201 bp, Homo sapiens; identical to SEQ ID NO: 947

SEQ ID NO: 949 - DNA, 201 bp, Homo sapiens
tgtggtggttcattcctgaatctccccgatggctgatatcccagagaagatttagagaggctgaagatatcatccaaaaagctgcaaaaatgaacaacatygctgtaccagcagtgatatttgattctgtggaggagctaaatcccctgaagcagcagaaagctttcattctggacctgttcaggactcggaatattgcca

SEQ ID NO: 950 - DNA, 201 bp, Homo sapiens
gtgggcagcatcattgccccctactttgtttacctcggtgcttacaacagaatgctgccctacatcgtcatgggtagtctgactgtcctgattggaatccycaccctttttttccctgaaagtttgggaatgactcttccagaaaccttagagcagatgcagaaagtgaaatggttcagatctgggaaaaaaacaagagac

SEQ ID NO: 951 - DNA, 201 bp, Homo sapiens
ggatgctcctaatttacatggagatgcctacctgaactgtttcctctctgccttgattgaaattccagcttacattacagcctggctgctattgcgaaccstgcccaggcgttatatcatagctgcagtactgttctggggaggaggtgtgcttctcttcattcaactggtacctgtggattattacttcttatccattgg

SEQ ID NO: 952 - DNA, 201 bp, Homo sapiens
ttggcaagtcagttcgtataatattctctacgttaggagtgtgcatattttatgcatttggctacatggtgctgccactgtttgcttacttcatccgagartggcggatgctgctggtggcgctgacgatgccgggggtgctatgcgtggcactctggtggttcatccctgagtccccccgatggctcatctctcagggac

SEQ ID NO: 953 - DNA, 201 bp, Homo sapiens
accagcaggagaaggaatgtgaccttcagtcagcaggtggccaatatcctgctcaacggcgtgaagtatgagagcgagctgacgggctccagcgagcgcgkggagcagcctctgtccgtggggcgcctctgctccaccatctgcaacatgcccaaggcgctacgcaccctctgcgtcaaccacttcctggggtggctctca

SEQ ID NO: 954 - DNA, 201 bp, Homo sapiens
tttaagaccaacgcaggatccatcagagtgtacaaaggaagttaaatcattaatgtgggtgtacgtcctagtaggcaatattgtacgtggaatgggtgaamctcccatcctgcctttgggtatttcctatatagaagattttgccaaatttgaaaattctcctttatatattgggcttgtagaaacaggagctattattgg

SEQ ID NO: 955 - DNA, 201 bp, Homo sapiens; identical to SEQ ID NO: 954

SEQ ID NO: 956 - DNA, 201 bp, Homo sapiens; identical to SEQ ID NO: 954

SEQ ID NO: 957 - DNA, 201 bp, Homo sapiens
ggcagcggcttcagcagatcggcggcatcagcggtagcaccagcactagcagcatgttgagccgggcagtgtgcggcaccagcaggcagctggctccggtyttggggtatctgggctccaggcagaagcacagcctccccgacctgccctacgactacggcgccctggaacctcacatcaacgcgcagatcatgcagctgc

SEQ ID NO: 958 - DNA, 201 bp, Homo sapiens; identical to SEQ ID NO: 957

SEQ ID NO: 959 - DNA, 201 bp, Homo sapiens; identical to SEQ ID NO: 957

SEQ ID NO: 960 - DNA, 201 bp, Homo sapiens
cagtcctccactgccggggctgggcccggccgcgggaaggaccgaaggggatacagcgtgtccctgcggcggctgcaagaggactaagcatggatggcagrcggagagtcagagcaacctctgtccttcccagatatggtccaccgtgcctatttaaaggacacttgagcaccaaaagtaatgctgcagtagactgctcgg

SEQ ID NO: 961 - DNA, 201 bp, Homo sapiens
ctgtccttcccagatatggtccaccgtgcctatttaaaggacacttgagcaccaaaagtaatgctgcagtagactgctcggttccagtaagcgtgagtacragcataaagtatgcagaccaacaacgaagagagaaactcaaaaaggaattagcacaatgtgaaaaagagttcaaattaactaaaactgcaatgcgagcca

SEQ ID NO: 962 - DNA, 201 bp, Homo sapiens
cagtcctccactgccggggctgggcccggccgcgggaaggaccgaaggggatacagcgtgtccctgcggcggctgcaagaggactaagcatggatggcagrcggagagtcagagcaacctctgtccttcccagatatggtccaccgtgcctatttaaaggacacttgagcaccaaaagtaatgctttttgcactgactcct

SEQ ID NO: 963 - DNA, 201 bp, Homo sapiens
gcactctccagctggtcaagaatcacatggctgttcactataataaaatcctttcagccaaagctgcagtagactgctcggttccagtaagcgtgagtacragcataaagtatgcagaccaacaacgaagagagaaactcaaaaaggaattagcacaatgtgaaaaagagttcaaattaactaaaactgcaatgcgagcca

SEQ ID NO: 964 - DNA, 201 bp, Homo sapiens
agcccggccgccgccctgggcaaggccctctgcgctctcctcctggccactctcggcgccgccggccagcctcttgggggagagtccatctgttccgccaragccccggccaaatacagcatcaccttcacgggcaagtggagccagacggccttccccaagcagtaccccctgttccgcccccctgcgcagtggtcttcg

SEQ ID NO: 965 - DNA, 201 bp, Homo sapiens; identical to SEQ ID NO: 964

SEQ ID NO: 966 - DNA, 201 bp, Homo sapiens; identical to SEQ ID NO: 964

SEQ ID NO: 967 - DNA, 201 bp, Homo sapiens
atcgtggtgcagaaaggagacgaagcgggcggctacgtcaaggtctacaccggccgcaaggtggggctgtttcccaccgactttctagaggaaatttaggygtgcgggcgcctgcaagcgggagacacccacaccccattctgggcgggcccagtggagtttggggaggggggcgaaagcaacgggactgctgggagagga

SEQ ID NO: 968 - DNA, 201 bp, Homo sapiens
tttcttctggatcggaatctgaaggagacatttttactagccctaagagaatttcaggcccggagtgtactactcccaaagcttccacttccgcgaacaarttcacaaagtcaggatccactcctctgcctctttccggtggaacctcaagttccgataactcatggacaatggatgcctccattgatgaggttgtacgta

SEQ ID NO: 969 - DNA, 201 bp, Homo sapiens
acccctcgctgcccacccagtggtctgttgactcccttacacttggagggccttgtccagttccaagatgtctcctttgcctacccaaaccgcccagatgrcttagtgctacaggggctgacattcaccctacgccctggcgaggtgacggcgctggtgggacccaatgggtctgggaagagcacagtggctgccctgctg

SEQ ID NO: 970 - DNA, 201 bp, Homo sapiens
agtgagaatctgagcttatttctgtggtacctggtgcgaggcctatgtctcttggggatcatgctctggggatcagtgtccctcaccatggtcaccctgarcaccctgcctctgcttttccttctgcccaagaaggtgggaaaatggtaccagttgctggaagtgcaggtgcgggaatctctggcaaagtccagccaggtg

SEQ ID NO: 971 - DNA, 201 bp, Homo sapiens
atgtgggcagaagaatatgaaggaaacatgactgggaagatgaaattgaggaatacagtacatctttcatatttgactgtaactaccctatggagcttcaraccctttactctgtccctgatatcttttctgatgctaatctgttctctgtgtaaacatctcaagaagatgcagctccatggagaaggatcgcaagatctc

SEQ ID NO: 972 - DNA, 137 bp, Homo sapiens
ttgcctcattacttttctatatagcagaatgatcttttgaaaatgtgaaccagatcacattattccctagttaaaaccccccaaggcttcccatcacactwggaataaaatccaaaagaatttttctaaaccaaaaa

SEQ ID NO: 973 - DNA, 201 bp, Homo sapiens
gggagactcggggctccgaggacgagacggacgacgatggggaagacttcacgccacccatcctcaaagagctggagaacctcagccctgaggaggcggcycaccagaaagccgtggtggagacccttctgcaggaggacccgtggcgtgtggcgaagatggtcaagtcctacctgcagcagcacaacatcccacagcggg

SEQ ID NO: 974 - DNA, 201 bp, Homo sapiens
ccagtgggcttcacagggcccatggtgcagggtgttgggatcagttttgccaagtcaaacaagcaggtctgcactgacattgatgagtgtcgaaatggagsgtgcgttcccaactcgatctgcgttaatactttgggatcttaccgctgtgggccttgtaagccggggtatactggtgatcagataaggggatgcaaagcg

SEQ ID NO: 975 - DNA, 201 bp, Homo sapiens
cggccgagttatcacagtggaggatcactacagggaaggtggcattggagaagctgtttgtgcagctgtctccagggagcctgatatccttgttcatcaawtggcagtgtcaggagtgcctcaacgtgggaaaactagtgaattgctggatatgtttggaatcagtaccagacacattatagcagccgtaacacttacttt

SEQ ID NO: 976 - DNA, 201 bp, Homo sapiens
tagactttgattttacggatatcttgcttctgttccccatggagctccgaattcttgcgtgtgtgtagatgaggggcgggggacgggcgccaggcattgtycagacctggtcggggcccactggaagcatccagaacagcaccaccatctagcggccgctcgagggaagcacccgccggttggccgaagtccacgaagccg

SEQ ID NO: 977 - DNA, 201 bp, Homo sapiens; identical to SEQ ID NO: 976

SEQ ID NO: 978 - DNA, 201 bp, Homo sapiens; identical to SEQ ID NO: 976

SEQ ID NO: 979 - DNA, 201 bp, Homo sapiens
gggactttgattttacggatatcttgcttctgttccccatggagctccgaattcttgcgtgtgtgtagatgaggggcgggggacgggcgccaggcattgtycagacctggtcggggcccactggaagcatccagaacagcaccaccatctagcggccgctcgagggaagcacccgccggttggccgaagtccacgaagccg

SEQ ID NO: 980 - DNA, 201 bp, Homo sapiens
gcagaaacaccaaaggcggcttccagtgtctctgcgcggacccctacgagttaggagacgatgggagaacctgcgtagactccgggaggctccctcgggtyacttggatctccatgtcgctggctgctctgctgatcggaggcttcgcaggtctcacctcgacggtgatttgcaggtggacacgcactggcactaaatcca

SEQ ID NO: 981 - DNA, 201 bp, Homo sapiens
ggctgccgagagccctctgagggcaaagtggcaggacactgcagaacagcttcatgttcccaaaatcaccgtacgactcttttccaaacacaggcaaatcsgaaatcagcaggacgactgttttcccaacacgggtaaatctagtaccatgtcgtagttactctcaggcatggatgaataaatgttatagctgcatttgtc

SEQ ID NO: 982 - DNA, 201 bp, Homo sapiens; identical to SEQ ID NO: 980

SEQ ID NO: 983 - DNA, 201 bp, Homo sapiens; identical to SEQ ID NO: 981

SEQ ID NO: 984 - DNA, 201 bp, Homo sapiens
acgggtatgagctccaaggccgggagcagctcacttgcacccaggaaggatgggatttccagcctcccctctgcaaagactccgggaggctccctcgggtyacttggatctccatgtcgctggctgctctgctgatcggaggcttcgcaggtctcacctcgacggtgatttgcaggtggacacgcactggcactaaatcca

SEQ ID NO: 985 - DNA, 201 bp, Homo sapiens; identical to SEQ ID NO: 981

SEQ ID NO: 986 - DNA, 201 bp, Homo sapiens; identical to SEQ ID NO: 980

SEQ ID NO: 987 - DNA, 201 bp, Homo sapiens; identical to SEQ ID NO: 981

SEQ ID NO: 988 - DNA, 201 bp, Homo sapiens
cgactctgaggagatggagtatcgctgaggtgatgagagagaatgtggttgttagcaacatggagagagaaagtgggaagcccgtggctgttgtcgcagtygtgactgagccttggtttacccagcgatacagagaatatctccagaggcagaaactctttgatacacagcaccgtgtggaaaagatgccggatggctcgg

SEQ ID NO: 989 - DNA, 201 bp, Homo sapiens
aaacattggtaaagttgattacatcaaagaatctttagcttatcttttgaagctactggatattattggtctctctaggtttttatataaatagtgaaatytgaattactgaaaaccatgttaatttttagaactcattttcctcagtagagactagtgatgcattagcttctgggaacaaacttgtatcggttcttaatt

SEQ ID NO: 990 - DNA, 201 bp, Homo sapiens; identical to SEQ ID NO: 989

SEQ ID NO: 991 - DNA, 201 bp, Homo sapiens; identical to SEQ ID NO: 989

SEQ ID NO: 992 - DNA, 201 bp, Homo sapiens
caagagttcctgaagctcctcatggagcggctacaccttgaaatcaaccgccgaggccgccgggctccaccgatacttgccaatggtccagttccctctcmaccccgccgaggaggggctctgctagaagaacctgagttaagtgatgatgaccgagccaacctaatgtggaaacgttacctggagcgagaggacagcaag

SEQ ID NO: 993 - DNA, 201 bp, Homo sapiens; identical to SEQ ID NO: 992

SEQ ID NO: 994 - DNA, 201 bp, Homo sapiens
agattggggaggcagcagatgacaaggtctccatctcttgctttggtagcttgcggaacctttctagcagttaccaggaaccaagcgacagtcatagtcgkcgtgagcacaaggctgtgggccgggcccctctggctgtcatggaaggcgtgttcaaagacgaatcggacacccgcagattgaactccagtgtcgtagata

SEQ ID NO: 995 - DNA, 201 bp, Homo sapiens
ctctttgccactggtgccttctcttaagtaacagggaacctctcccacctgcccttctcttcagggacaaccctccataaatgtgtgccaagagggtctcytttcctgtcttcctctacagagaatgctgctcggtcctcctacccctcttcccgaggccctgctgccatgttgtatgccccagaaggtaccttggtcccc

SEQ ID NO: 996 - DNA, 201 bp, Homo sapiens
agaaacaaaggtttaggcatcgcaaccgcaaaggctaccgttcacaacgaggccacagccgtggccgcaaccagaactcccgccggccatcccgcgccacytggctgtccttgttctccagtgaggagagcaacttgggagccaacaactatgatgactacaggatggactggcttgtgcctgccacctgtgaacccatcc

SEQ ID NO: 997 - DNA, 201 bp, Homo sapiens
tcgtttaggttttgtgtcgtgatggggaaacagcaaagcaaactcaaacacagcacttataaatacggacagttgtggcctataattggaaaactggaaakgtggtgaaaaggttcaaaggacatgaacatgagatcaccaaggtagcctgtattcccaaatccagccagttcttcagtgcctctcgtgacaggatggtca

SEQ ID NO: 998 - DNA, 201 bp, Homo sapiens
catggataccgtctctgtcgtggctgctttgaactcagacctttgtgtctctggagggaaagataagacagttgtggcctataattggaaaactggaaatktggtgaaaaggttcaaaggacatgaacatgagatcaccaaggtagcctgtattcccaaatccagccagttcttcagtgcctctcgtgacaggatggtcat

SEQ ID NO: 999 - DNA, 201 bp, Homo sapiens; identical to SEQ ID NO: 998

SEQ ID NO: 1000 - DNA, 201 bp, Homo sapiens
atccagccaaaaagctgctgctgacagccagcggggatggctgccttggcatcttcaacattaagaggcgtcggtttgagctgctctcagaacctcagtcyggggacctgacctctgtcactctcatgaaatgggggaagaaggtagcctgtggctccagtgaaggtaccatctacctcttcaattggaatggctttgggg

SEQ ID NO: 1001 - DNA, 201 bp, Homo sapiens
tttgacatggagtggccaccattatacaatagagggaaacttggcaaagttgcactaattcagttgtgtgtttctgagagcaaatgttacttgttccacgrttcttccatgtcagtttttccccagggattaaaaatgttgcttgaaaataaagcagttaaaaaggcaggtgtaggaattgaaggagatcagtggaaactt

SEQ ID NO: 1002 - DNA, 201 bp, Homo sapiens
ccgtactgctgtctcggggcatggctcgcctggtggtcatcgactcggtggcagccccattccgctgtgaatttgacagccaggcctccgcccccagggcyaggcatctgcagtccctgggggccacgctgcgtgagctgagcagtgccttccagagccctgtgctgtgcatcaaccaggtgacagaggccatggaggagc

SEQ ID NO: 1003 - DNA, 201 bp, Homo sapiens
catattccaatcttgggcagcttccagaagtctgtaccacacagaaactcttcgagtgcagcaactgtggaaaagccttcctgaagagctccactctcccyaaccatctgagaactcactctgaagagataccatttacatgcccaacaggtggaaatttcttagaggagaaatcaatccttggtaataaaaagtttcaca

SEQ ID NO: 1004 - DNA, 201 bp, Homo sapiens
accatacaaatgtgaagaatgtggaaaagcctttagtgtattctcaacccttactaaacataagataattcatactggagcaaaaccttacaaatgtgaamaatgtggcagtgcctttagggcattctcaacccttactgaacataagagagttcatactggagagaaaccttacaaatgcaatgaatgtggtaaagcctt

SEQ ID NO: 1005 - DNA, 201 bp, Homo sapiens
cacacccatgtgagatgtgtgacccactcttgaaagacattttgcacctggctgaacaccagggatcacaccttacacagaaactgtgcacacgtgggctytgtaggagaagattctcgttcagtgcaaacttttaccagcaccagaagcaacataatggagagaattgcttcagaggggatgatggaggggcctcatttg

SEQ ID NO: 1006 - DNA, 201 bp, Homo sapiens; identical to SEQ ID NO: 1005

SEQ ID NO: 1007 - DNA, 201 bp, Homo sapiens
tatttattatacatatgagaagtcacactggtgagaaaccctatgtatgtagtgaatgtgggaaagccttctctcagagttcatccctaaccgtacatatycgaaatcatacagctgagaaaccctatgaatgtaaggaatgtggaaaagccttcagcaggaaagaaaatctcattacacatcagaaaattcacactggag

SEQ ID NO: 1008 - DNA, 201 bp, Homo sapiens
gggacaaaatccaaatgttggtcaaagtcctttttctcccagacatgttcacacgtgggtgcaagctgatctccattgtcagtacacagatgcccatgaawaatgccgtggatatacacatgtgtgttgcacaagctacacaagctaaagctggtaacccaaccctgaagaccctcacgagctgctgtgggggatcttggc

SEQ ID NO: 1009 - DNA, 121 bp, Homo sapiens
gatgttaggtctctgagatcrtagtaatgcagtcagcaatgaaacctacctggttaattagagaaacacagctccatcaatgtaagagagaagtctggtaagccttcttatggaaaattct

SEQ ID NO: 1010 - DNA, 117 bp, Homo sapiens
gtaggtaagcaaaacaaatgtgcttcccagaaccctccaaactgctcgtgggtatattactacagattacataatgcagcagcgttccgggacgcaagccsagaaaaagataattaa

SEQ ID NO: 1011 - DNA, 201 bp, Homo sapiens
tgactactgagcatcaccctggacgtgtacaagtctgcgtccttattgttttcttcattgggccgaactttctggtcctcatccaacagctcttctatcaygtgttcgaaagtgtcagccaatgatgtcaagcctcttgaacctgccttgggcccattcacgctctccagagtcccatgggtccgcacacctggagatact

SEQ ID NO: 1012 - DNA, 187 bp, Homo sapiens
atagtgtccgtgtgtcatgaaaaacttatttgtaaacgtttatatggtatgattttgattttatgtatgttcataaatcctgcactgtatgatatatgtgrgttaaaacattggtgcatgaatttattttcaaagtataaaacacatcacttaaacattttatgtgtcaaataaaatttgattatgt

SEQ ID NO: 1013 - DNA, 189 bp, Homo sapiens
tagtgtccgtgtgtcatgaaaaacttatttgtaaacgtttatatggtatgattttgattttatgtatgttcataaatcctgcactgtatgatatatgtgarttaaaacattggtgcatgaatttattttcaaagtataaaacacatcacttaaacattttatgtgtcaaataaaatttgattatgtaaa

SEQ ID NO: 1014 - DNA, 153 bp, Homo sapiens
atgtgggcacttcccttccatcgtggtgaggccaaagcaaaggcacagagacstgaacacaaacatgaaaaacaccttaccacctgggagtcaggggcaggttcaggcacatccattcctctggcatttgagcagctgttttccacagcatta

SEQ ID NO: 1015 - DNA, 167154 bp, Homo sapiens
cagttgtccatttgttctatgaagttgccatgtgtattagatcagttcgtctctctttttcattttggtacctgttttaatttttatctccaaatttttagagtttgttgtttataggattgaaaaaatctataagcatcttattttacatcttatttttttagaatgttaatactttatggagcctttttcaaatgctgaactggtgtttgttttttaacttttattttaggttcacggggtacatgtgaagatttgttacttaggtaaacccatgtcatgggggtttgttgtacagattatttaatcactcaggtattaagcccagtacccaattgttatcttttctaatcctctccctcctcccatcttccattctcaagtagaccccagtgtctgttgtttccttctttgtgttcataaattctcatcatttagctcccgtttataagtgagaacatgtggtatctggttttcttttcctctgttggtttgctgaggataatagcctctagctacatccatgttcccacaaaagttataatctggttcttttttatggctgcatggtattccatggtgtgtatgtaccacattttctttatccaatctgttgttggtgggcatataggttttcatgaaaagattccaagtttttgctattgtgaatagtgctgcagtgaacattcacgtgcacatgtctttatggtaaaatgatttatatttctctgggtatatatccagtaatgggattgttgggtcgaatggcagttctgcttttagctctttgaggaatcaccatactgctttccataatggttgaactaatttacactcccaccaacagggtgtaagtgttccctttttttcacaacctcaccagcatctgttattttttgactttttagtaacaggcattctgactggtgtgagatggtatctaattgtggtttatatttgcattctctaatgatcagtgatattgagcattttctcataagtttgttggtctcatatatgtcttctttagaaaagtgactattcatgccctttacctactttttaatgggattctttttttctcttataaacttgtttaagttccttatagaggctggatattaggcctttgtcagatgcgtagtttgcaaaaattttctcccattctggaggttgtctgtttactctgttgacagttttttttttgtttttttttttgctgtgcagaagctcttaagtgtaattagataccatttgtcaatttttgtttttatcatgattgtttttggtgtctttgtcattcaaaattaatatcattgacatagaaaattctcacattgttgcagcattttaaaaaatctgttactaagtataatatacactaagaccctaatttggtttactaattttttttaaaggaaacacaccatatgttgataaaggtttatctaggcagttaagattatactaacttttattttttctttgtatcacctaaattttctacagtaaacaattttttataatctgctttttttaaaaaataaaacatagtaggaagtcattaaactcgggtctagtcttaattgtgccttaagctgtgtttctttgcattctctcttcagccttatgtttccagtttaacttataaatttatcttccaaatttctgatccctctgaaatcttataactaacatatttagttttaccttttgattttgatttaaagaataagacaacatttctgattcactttttcaatatttcttatttgctattgccatatatttcagaaactacttgtggtttatttctgcagttcatgttctttggtggaatgagagtgcagatagtcgtgcagctgggagacataagtcccatgaggatcccagagttgtggcggctggtaagctgtttcactaagcacgaattatttttagaacaaatgtgattcaaccaataactgtatgccttcttatgaaatgtttttccagttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggtaagttaattagttaatttgctgtgcttcttgcatttttgaaagttacatattctccactgctttaagaaataattcagttcactttcaccttggcatttcagtatctgttacacattagaagtagttgtcactatttcatcatcttggtttttcatttgttttagaatacctcttctgtattttgataactcattgctttatagcattttcttttactcaaataaggattttacatttccttgcctgacagtatttttgaattatttatataaaatatctatcttttcatcatgtctatagttcctgagattttaaaaaaatttgcttagtaaaggttattttgtgatataaaatgggatttataaaaatattagattgtttatttctttactgtggaaaagtacaatgtcatctgtattaattattgcttttacattcattgattattagtcattctaacttggaaaataatgcaattgggtcacagtgttaaaaatctagaaaagacttgttggtttatatgctgaaattgttcatttataattaattttactaatttctacttagtttggatcactaacagagatcttgggacatttatttgttttaaagaaatatttatggttatggaaacgcttgccctaataaaaatcctgcatattcattgtttttttaaattcacattttatacttatatgatctctaaagctcttgctatgttgctataagacagtaatatagtgataatttaccaactttattgaaaatgttgttacatcaataaaatagcatgctgggaacctgagaaggaaggtttctttagtactgccacagatgtcctggagttttccttgaaacatctttcatttccattttacttgatgcctctacctactaaaactagatttggtacttccgatagtgtatatttacagctatattatatttacatttttacagactatcttctgataatctgtatttacagctatgttattttatatttttaaaatcttacagctataaaatagtaaattgtgaattagctgtccaagggcaatttggaaaacaaactgtacagtttcctctcatttatcaggctctaagcgatctgcagtttatctgggctattatgcaatgtgagatattatttatgagaggcaggcagtggcagcttaaacagacatacctcctcagcattcttttccatgcagagttcaaagaggcctaagacatctcacatttatgtgaaatagttgaggcacaagtatgtggttaactacacataaattaccaataaaattaaaagttaactaaaatactacagaagacatttaatattttgcttcagactgttatagtaccttagggttatgaacatcaattacctttgagccttactatatttaaagggaaggggaagctgacatttttatcttttttaatgggtacactctacgttaccttaaaggcttccccggtttaagcaaaaatagaattatgtggtttaaatcatataccttattcttcatacttagctccaagtagattatgacttttcctaaaacttaacatgacagagatttgccttccagggggtctaatttgaagaggaaagtaatttaaatgtataggtttatataatagcattgtatttttctctattttattcattctttcattctcttcgatgactcccagcacctgcgcgtccatcttcattcttagccaatgacctttccttttacttaacagagaaaataacaatcagaagagtcttcataagttcccaccccgtctgcccgctttctacagccaaccccacatgccctgccttctctcctttcactgtggatgaaccgcccgtgccccaagcaaagacaaaccctccacttgaacactcacttgctgaaggatgtggcttaggcagttttcctgtctcctgaagccacagtattccccttcaactggattcttctcctcagcatataaatatacttttttttcctatctttaaaaaaaaaaaagagtaaaatcaccccatttttttcctttacaatatgactcaaaagagtagttcatacttcctgcctccattttcttccctcacattatctcttaaacattctctgatcacgccagccaaattgctcttgtcaactcatttcccagttctcatttcacttgacttgttagcagttgacctctcctttcttctgggaagtttcttcgtttctccgaaacactcactgcacaagccttcatatctcctagtctccatcttgtctctttgacctctgatgtaaggactgagtccttggaccacttctcttttctatttatacttactccctgcgtcatcacccccagtcttgtggcttcaaatgctatctgtgtgtggatagctcctccagtccacacctcttttctgaatcttttttcaaattcacacatgtgaatttgaattccaggctcatcacatccaggtgtgttccccacacctccacctgaatgtctattagaaatctcacacccctcttgtccaaaactgagctcttgatctttaaccagaaactttatctcagctattggcaactccaggtttctgttttgctcaggccacagacttcagagtcattctcacactgccttttctctcatacaccattatgtacctgtcagcaggtcccaaatatctagaatttgattgcttcacatccctatagcaactctcctggttcaagcccatcatcatctggatttttgggaagtggtcttaactggtgtgctgcccttcccctctgctctcaaccctattttcaacatagcagtcagaataatctaaaatataaaccagatcatatcactcctctgctcaacaccccctcccaataccttcatgtcatcctcagagttattgtccaagcctctaactgtggtctacaagtctttacatgatctgtcctgttacattttccactctcgctccagacctgacctaagaggcttttctctgaacttgctaaacatgctcttacctgagggtccattcccactgcctctgcctggaatgctcttccccagacatgcatctgcgtggatcatttccatgcctcctcaggtctttgccctcatgaagccttccctgacaaccctatttaagattgtaatcccctcccacagtggcccctatctgctagagactgaatgtttttgtccccccaaaattcctatgttgaagccttaatctcaacataggaggtttggcctttgtgagttagttttagatgaggtcatgtgggtaatagaattagtgcatttataagggcgtgaagagccctcactgtgaggaaaccagaatgtaagccttcaccagaacttcttcatgctggcaccctggtcttagacttcccagccactagatctgtgagaaagaaatgtttgttgtttaagccaccctgtctatggtactcttgttacagcaacctgaactaagacactatccctctcccctgctttctttttctgttatcaccataattaatgttttacttatatatgatttgttaatgtatgtctcttcccactagaaaccgaattctatgacagcaagggtttttgttttcattattgtcatattacctgtgcctggcatgtgataagccctaagtacttgttgactgaattaacatatgagatctgtgagtctgaaaaaagaagtacatcattccttcacatgtcattttgagccactgttaacagattacataactgttattggaagtgcctcactactccatttggaaagtattcctggaatacacgatgaatgactcagtagaagttctggctatgggggagtgccatcaataaataaaaataataccattgtctgttggttataagttgctgtcacagactatgaaggtatttgaattgtattttcaggaagagaaacagatatgcaaccaatctgatttggttccacaccctgccacagaagtcccaaaggagaagcaaatgccacttgtagactcaaactctggacttcattctcagcaccatctcttaacctactgagtaaatcctatgaacctgactagggtggcaactgaagttgtagtactttctgtcttcaaaggagggtgaacctggagtatgttggaagaagtgttaggttcattagagacacctctttcataactgctgtcacctagaatgtctattctctaagcaccttcttgaaagaagcacattcccccaggaggaggaaatggtttgttttctttagtgacagttggcccaggatcctaaggtaaaggagtatgggcactagacaaaatgagttttataatagtcgattggaaggaatggaagtttttgaatcacaggcttctgccttgaaagggcaagtccgtggtggtcatgaaccacccagagtgtgtacaaggctcctgccagaagaaatgcctgtaggattaaaagcaaaacagcagaatcaaaaaggaagggcacgatgatgcccaggtgcagcctatattattaacagacaaggaaagaatccaaataaaagttctgtaaaccagctgttgtcctgttttctgtttcccttcaaagcaaaaatatagatttgcatatatttgcagtctccccttccttgcctctcagtcttccctgaaaatctattccagttaggtctgcatccttgtcatgctgaaatgactcttaggaaggtcaccaaggacctctgtcttaacaaattcaatagccattcctgcctttactcatttacattccttactcatcttctcagcaatgttggacataattgacaacttctgccttcctgaaacaataattctctgagcttcaacatatggcattatactcttcagattttactctctctcactggccagtccctctcaatttccctggctagcttctcttctaaatgttataggatctcaggctcaagaatgttccctatcttcattctctctaggtaatctcattcagtcccgaggcttaaatatatacgtaccaataacttgcacacttttttttttagatggagtttcgctcttgttgcccaggctggagtgcaatggtgcgatctcagctcactgaaacctccgcctcccaggtgcaagcgattctcttgtctcagcctcccaagtagcttggattacaggcatgcaccaccatgcccagctaatttttttgtatttattagagatggggtttcaccatgttaggctggtcgcaaacgcctgacctcaagtgatccacccgtctcggcctcccaaagtgctgtgattataggcgtgcaccaccacgcccagccaacttgcacacatttatcttattttccatcattgcccctgagcttcagactgaaatacccactgcatttttaacacaaccatctacctagttcaggtcacaaactagaagtcaccttgctagctctctttccctcagcccttacatgcagtctgtcagcaagtcctgctggatctatctccaaagtggatactgaacattaccatagctccctatctgttgctaccatcttagttcaatccaccattatctattagtcttcctactgtcctttcttcccatagtagccagtgttctttctgaaacagtaggtcacaccactactgtttaaaactctccagtggctccttgttgcactaacaataaaatccaaataccttaaaaaggctggcgagatcctgtgagatgtggtccctgctatctctccagttccaccccctgccactcttgtccttgctaactcagtacaagagacattagtacagatagctcttttaccacctcagcttgccaagctttttcccactggggcttttgcaacacttattctttcttccgggaatatccttcgcacccaccttgaaaggctgctcctgctctttttattcgattctgagcatgtcactcctcagaaaaggccatctctgacttctctccattgttatccaattaccatgtcttattttcttcttagcacccattgctgtcaaaatacattagatgtgtttgtccacacatcatctttcaccactgaaatataaattcattagagcaggaattctattttcttctacattgtaccccctagtacctagagaagtatctggcatacagtaaagttcaataaatatttgttaaattaatgtatattgatgctgatgtgattttacaaggtcaattttaactgatacctaacttcaacaaaaagaaccctctgccacttgactgaacctgtacctttggacgagtttcttatccactgagctgtaatttactcatatgtaaaatggtactttttacctcatagggcaggtgttgagaattaaatgaagtgcatgacaacacagtaaacacttgaaaactgaagctaagtgggttttttttttttttttacttaatgtaaacattaccattacaaagtgccaagttttttgaatctggaaaagttcttttgggcttttctacagatagaagaatgttttagtcaaggctcatgggtagggccaggcaaggtggctcatgcctgtaatcccagcactttgggagcccaaggcagaaggatcaccttaggtcaggagtttgagaccagcctggccaacgtatagtgaaaccccatctctactaaaaatacaaaaattagctggttgtggtggcgcatgcctgtagtaccagctacttgggaagctgaggagaatcgcttgaacccgggaggcggaggttgcagtgagccaagatcatgccgctgcactccagcctggacgacagagcgagattctgtttctcaaaaacaaaaacaaaaagcaaaaacaaaacctcatgggtaacatattttcatctaaattacctgcctttttatttttcaataaagttttttcctctccctcgtcattgttcacgaagaaacagtgttctatgatttcattaaagtcactataacatgaacttcaagataggaggatgaagttgtgatgctgatgctcagggggcatcttggctcacttgaagccaagatttttctgcacacaaagttcagatctgtgccacaggaaaaggactgctcacgacactgtcacagccattcctgaggtcacaaatagagacagcctcttgtacttcctcaaaaggactgtttgacagggattcttcaagtagcaaaataagcagacatctctttctgaaactgattcttaatgagctatgaaaaatacatttacatttatcagcactgctcatatgttgtctgcacagcacttattacaggaaaaaaggaaggaatcaccgatattagtatcatttctgtttccatatctacttcgccttcctgctcaccattgccaccacccccagcaccttcccagtataactgctacattgtgtccttatatttttggttgaataaacaaaaggacactgaaggctgcctttgtagcttcccctataccaagtgaacatttattaaataagctcagctacagagcattttcagaaatctcagtgcagcttcataatcattaagcagaatatttatctaaaaacctctaacacttaataccagttactcagtatcttaaccaacatgaaaatacaaaacaaccttttattttcaagtagtcccctcagttctcttttatgattaagggaacatttgaatcttttctaaagtttttccttttgatccaaatcacttcccctctacttttctaatggctttataacccttcaacagtaggtggtgccacaaatgcacaaaagtaaatttctgtagaccaacagaactgtcacagctttattttgtgactcattatattacaacatagaaatatgcattttaatacttcatataaagttattgacatacaaaattttttttcttttttccttttaatgaaaatgatttaacttagaaatctgttgtgaaacttttgtctagttttgcaattctcagatattccagtgcaaaaatagatcccattacagacagcgtaaagtgcttggaatgagggccaatgatgaacaaagagcacaaaaacagcttcatcttagggtataagaagggataatagcatacctaaatccttatggaaatagaaacattctaagggggatgcaacaattttgaaaagaattagagcaatatttctacagtattacattattactagtagataataacaagggtacaaattaatgtctcaatatcaaagtggttcagtattacatgacacatggctctttggaaaatattttacctgatatatacaaccacaagaagaaaacacagacaaatggctttagtcaatgattactatacagtgaatgaatgatgtgcaacatttaatagtcacaaagcatttgctttcagtacagataatgaaatacagtagtgtgaggtttggttgttttttaacaatgaattgtgctgggcatttatgtatagagggcttattattttcttctgtatttctcatattcacagttgttaataagttttctgaggtgtcccaaagatgcaaaagcagaaatttttgaacacgtattttgagaatttctgaaactcacataggtacattccacagggaatatacagaaattttgcttgattgagtatagagttggtaaaaatttctaccacaattaggtttacacaggaaaatgtaaaaaattactattttaaaaggtaacacagtattaatgaagatgtataactatagattgtttctagcttcagaagaggtcctttcaatctgtattaaaatgttgtgttttcttcaaaatagttcacagtgccttttgattttttaaaatatggccttgaaatcagaggaaccgaagtaaggagttgctcatagatttactataatgaagaattagaatacgattttagtaaaatgaggaaaccataactttgattttgaaaaatattaaatgaggagaaattattctataaattctgtatttttgaagatactgtaaaatgcaacgatgccatatcactagttattggaaatatgccttcattacttatatttaaaatcaatattgactttaacttctaaaacaatcatttttttctttttcagcagtgggttatataatattctgtaaatttaaaaaatatagaaagattaatttgaaatctgaagtcttacacctttagcgttaatattcaaattctggaaaaagtggaagaagttagtaatgatattgaaagatcacttgaacttccccaaacaatagttctctcatatttttcttttctctcaagacagttaacagtaagtattagtgaaacagtatttttacaaatgtttactgactagaaaaataagactgggttagaaaactctgaaaaatgctccatatggaagtatttgttgtttttatatttttcttgactagtgattgaagagatgaaaaatttgagactgtcagatttaatggggtatccaatatctgcaaagccaattatttgaaggtactaaatgccataaacacaagttgtgtttttcagcaagttttcaagctagctgttttccctgttgaagaattcattgtttagacttgtgacccttatactttcttggcttttgcattgttgcaattaaaaaaaaaaaaaaaaaggctgcccagtattgttacagtgggctcctacaaccacaagacaacctatatttgtaaaccagtgagctgaataacatggcacaggaagtgtactgagacttaatatctctctagtcttatacgtacgtacatactctttcagctacagcatacactcaaaaaatatttgattgatgaagtgagattaagagtatcctaaatgatctgaaagaaactcaaatataatgtcatgagatcctgaccatcacattgctttctaggcactagtcatgactgatatgcaaacttacataagaaaataaaaatagtggggcagtggccatactcctctataccacagggttctacaaagaggccattctaaggattcagaagtcactgatagaacttaaaattccaaataacattaaaaagtacaaacatttttgtcaaaatacaactccatcttttcattttctagattaattcaaaaagccagaaataatacacttgtgtcagataaacatcttgagatgcagtgtaccatgttagcagacagtcaggacaaatgggcacaggcttccctaggtttgaacgcacaatctctttaatcccatgccctggcttcagcagcttgcagccccagcagtttggctgttgattctttgcctcttaccaggatctaagtatatttaagagtctcataaggatgaccctgtagacccatggctcgaagcataggacaatataacaatggaaccaagtttcccgtgcctggagacacccacatttttgttgcatgttactgccaccagaacagcttatcagagggaatcaaagcaggatgttagccacgcatggcaccattctgtcaactgatattcaatgttgatagactctgagcagagcagctttcacaaaagtgagcatgacacaccatggtgcttcaaactttctgaaaaacttggcactaataactctggcacactcattgccagcaatggatgtgtcaccgggaaaccagtctcctgggcatggcatggcttagtgaatgaggatgtgcattaccttttgattttgatcaataatcgctggccatgattacttgatgaattattgttgcaaccccaatgagaatacacaggaacaaaaaaaaaaaaaaaagtgtgagttcaaacccatatgtccattgggttccataatagagtttcacataggtataggtaaaaaactaaattcaagtctttcacttgagagccatacaagacataggctacaaaggcactgcccctgtaatggaattttgttttcattgcattgaattgcattgcattgaatagtatcagtacagtatccagtttacttcttcccacatcaacttctggctcttttctccacaacacttcacatggtgcaaaggaaagtctagttcctctttactttcagccaccccgtatgaacaggattcttcatacatagctttctttcactttctcatcctgtagaaaagatgtgagaactgcaacgtccactactgtctggtttttgtgtaatgagaggtcttttaagtggtcatcatcactttggtccttggcaaagttcacaaatacctgttaaaagattaagatggacctttataaataccactcaacttgctcattctttattctagttctatttttccagatgttgaaattaggtcaagtaggagcatacagaattacataaatggattaactagaaaactgtgtgtgaaggagggaagaatacttgaaaaaagcaataacaacttaaaaatagactttttttccccccttgaaatggggtcttgctctgtccccaggctggagtgcagtggcgagaccttggctcactgtaacctccacctcctgggttcgagcaattctcctgcctcagcctcgcaagtagctgggactacaagtgcgcaccaccatgcccagctaatttttgtatttttagtagagacggggtttcaccctgttggccaggattatctggatctcctgacctcatgatctgcctgctcctcagcctcccaaagtgctgggattacaggcatgagccaccacgcccggccaaaaactgactttctatatcgccccccacccctacatcaccaactgctcagtcatccatttactttggcacatacggtcttgattaaagggaagagggaagaaaatatttactgagtacttcttaagtgtcaggacctatttggtacttttttatctaatttaaataggattaggcaccaagtaaaatgcctggcccatggtaggtgctcactaaatggtagtttttatggttattattacagtaaattctcacaataatcctatagagtacataggcatcatctcccttttcaggttcagagaggtttagtaaaaagcatagctaggaatagtagatcaggaattcaagcaccaattcaagatacaaactgctcttggacctatgggcgggagtgtcggggcaggaatccacaccctgagaagtaaatctgttttgacactcaaagcttacttggtcaagtgttgtctgagaaacagagtagtcttctatgtggagtcgctttttgctctgggagaggatgctgaatatcctggccagagaagataatgaagatggaagctggtattgtagcatgttccggtgtttctcttttagaacacttccaggaaatgcaagtccaaagaaatcctggacaggcttcaggtccgggttggaccctgctattcgtacaactattgtataaccatctccaaacctgaaagcaggaaaaaatacccaaatggaggatctccagaaaactatttaaaagaatactgaaccctgggaacccaacttgtgccatgaaaaagggcggcccctggcaggcccagaaataagtttctgagagaaggaaccagttatcatttactaaatacttattttatgtgaagcaccatgccatgtgctgtaaatacatgatctcctttaatcctcacctggacccatgaagtctgacagatgttacagagaaactgaggcccagggagttagtcacttgcccatggctcagagctcataattggtagggccaggatgcaaacccatttgtgtttgactccaaagcttgcgctctcaccagtactggcacatgtaaatttttttcatttcatctatagcacaaagctaggaggtagatcttccagggaaactaactcttacagtagttaagtcacttgcccaagagtcacagaaccagtaaatggtaaagacagaatttgaatgcagttcggacttcaaagccctcattctttccactatactgttttgctcagttttatttccctttatgttagaggcaccatttatatactcacaaaagaataaatatcaagccttctcactaggcactatcccaaagaaattatctttattacctattttttagatgctggacactgccaaggcacctgaaccttccattgaccatgattgccatcctagtgcaaagagcttcacattcttccatactgcggtaaaacagaaagaggttttagttttagagagattctctgtaaccatgagaacatcaccatgacttccagcattccagcttcctagggaattgtattctgttacaagtacatgtggatatagggatgatgctgttcagtgtagtggtgtttacaattgtgaacaagttggaaataatccaaatgtctacaaaagggggaatagttaaataagagtatatcctaatggaatactatccagctataagaaatgacacctaaatgcactgacttggaataatgtttacaatatattaagtgaaaaagagcagtatttatactgggcttgcatttttgtaagaatatgcatatataatttcaggtaataattgttttactctttgcttttctgtattttctaatttttacaaaatgatcgcatattctacttggaaagttaaaacatcccacagtgaggaacccaagactttactacggacctatgagatgtaagcactactgatctcccctccttgacaacacttagggcacaattccacaagaaccgccgggctttgggatccatgcctgtggtgggttcatcctgtaattagaataaaataagtcttatttgctggggggaaaaaaaatcaaagataaatttgtttttaaatgcagaagcatctttgaaacagcttaaattttaacttgccattctagttatttcttgatgaatcaaagaattagagtaactttcaaattcatttgtaaacaaggtcattattataaatgtcttattgatgcaggaaactcaaatattctgagtacttttttatgtaattaaatttctccaaataaatagggaaggaaaaaggccatttagttgtaattatcttttcatgactgataagtatatacaaaacaactttttgtctgaaacctctattgaagtcagtataagattggggtgaaattcctttttttttttaattccagctcactcagattaccctagtatattgcaactgttagccttacagaaacaaattccagaccgaggtggaatacataaaagcctcaaaggcttcttcccgtaataacatcaatgctcttatctacagaagaaaaaaggtcaagggccacttcccagtctgatctgtttttcatctatccgtgtgtaaggaactatgacctagttgctaccttggggattttaaagctgtgtccacactcttcattttcagggaatgaacacaaagatgattagaaagaatgttccagagaaagatcaaatcacatatccagcctcaatcacgctaagaaacaaagtgcttggagtgcctctatttgggagcatctgcaggcatggtacagccaccccagtgtgtgccaagggagaagcttccctctgcttttccaaggttgctctgctgtccctgggggaagacaagccaatcatacaacagccctggacatataggacttttgaacagtcatgttttccactcaggccagaacaacagttttccatccacagttatactcaccagaaacaccacaggaggcccgccgatcaaagccatggctgtagagagcttgcgtttgttgcctccactatagttaccagcatatttttctccatacttcacgaggcccagtttccgaatcgcccactcaccaacctacagtgataaaaagcaccttgactttggtctggcttgggaattttatcatgctgtcctacacatacatgtatgaaagttctttcactgagtaggactagattctataatcataacctgacaactggtgaggagccaaagcagggagaagggactcgtgtggtgggagcagcactccctctctgcccacccagccctgccccaccaccgttacaggtttccaccctgaaagcagatacaaagaaccagcattttgtgctgctgcattcatgaggaaaaacagcctgaagtcaatgcgtgtggaaaagccataaggtatatattgtcaggatgccaaaggagacaggctggctttcaggtgcccacagtaccttgccaacttctttctctgggactcctctcaaaagggcaaagaactccacgtgttctctcccagtcaacagctctgtgatggcatcaaactgagggcagtagcccatgttctgatgtacttcatggatgtttgataagatactgcaaaggacaagaaaactacttagattttaagcaggtagagatactctggttagacaatctggcctaatgttcctgtaaagtatgcttctccattacaaagataccaatacatctgctgctacttgaaagcacagcctttctgcccccaggatgctagctcttcctggcaggcagggttcctgcctctaccctccccagtccttgcacctccctggctctctgaacacttcagtctgcaggtgcagtcccatttcagaatttctgaggtcatgccaaccactgcacattctttaccaacaatctcagtcacactaccccagggctttaacgctaaggccccatcctagacttcactcatatgcaccattcacatgcaccaaatgagaaggcccagaaattttgagtgtgagcaacacagaacctagagacacaatttatgtggtggtggggtggctttggggttctatgaagccagtcaagtgaagaatcacatgtgagagaagttcagtgttcacgttccagactgatgactgcacctcagccacagcggcattgccatgaacttggccttctggcagcattcattcctctctgtgtatctaattagcacccccagggtcagcctttttcagaattaggattgaggcacacgtggacaccgtgccaggccctcacagctataccaaccaaatcagttcttacaaccagtccctgtgacaaaccttactatgggctggttattactgccactgctatatgcgtcaggagcttggtactaggagcaagcctaggaaagcagttgtgcagcgctaggcctgctattcccagaatgtctgttctcttaggattcctttacattgctactgcaaaaatgtaagagacaggagaggagatcatgaatacattaatttccttgctcttttcaattttattggctatccccctgtccagtgtgttcaaattgtgagtcattgttcattagtggtttgggaaataaatttagtgggtcatgaccagcacttttttaatgacgcagtataaggtagaataagaaatagcagagtgcactacaattagtaacagtaggtactgctttatgaaactttaggttatacatgtgtctacatgtctgtgtgtacatactaggttgagatataaaatgtatttcccacaacggtcatggtcaaaaaactctgaaagccactgccttgtactatctctccacataataagtccagagaagccgggcgcagtggctcatgcctgtaatcccagaactttgggaggctgaggcaggtggatcacctgaggtcaggagctcgagaccagtctggccaacatggtgaaaccccatctctactgaaaatacaaaaaaattaggcaggcattgtggcgggcacctgtaatctcagctactcaggaggctgaggcaggagaatcgcttgaacctgggaggcggaggttgcagtgagccaaggtcgcgccattgctctccagcctgggcagtaagagtgaaactccgtctcaaaaaaaaaaaagcccagagaagccccacatatttaaagtacttagagtaacattatctaagaagcctataaaatgtagctgtattcccaaagatcagattgctttgtgacctgtgcagtctcagaaaatggcctaacggtggctcagtcaatttgtatgctctttagagagggcaatttactttgtaggaattgttcctgaggaaataataaaagatgtatacagggacatatttacatagtgaaaaatggaaactaatgtgtccaacatttataaggaatttattaaataaattataggtacatgtacatagggggattttatgtagcaatgtaaaattccacatcttaggaaatgtaacccactgggaaatattcataatacactcattaacaataaaaactaattttaaattctacatacagtatgatctcaattgtatggcacatttatatgtgtatataagacagatgtggggtgatggaaaagttctaaaactggattgtggtgatggttgcaaaactctcaatttaccaaaaatcactaaattatactcttaaaaaacaagcaaattatattgtatgtaaattatacctgaataaagctgttaaaagaagagaatgagactgaaaggaaatgtaaattgtgattatctctagatattgaaatcatggatgattttatgtgcttctttaccctttactatatttcaacatttttatgaactctaaaaataccactgtaatcaaaaataacaacctatttctttaaataaattaaaaacaaagtctttgcagcaaaatacaagccacttcttttctcacctatttttgttaaggaaagcatctcctctggtaacagtggtatctcctgttaacatcttgaaagttgatgattttccagccccattaactcccaggagcccaaagcactgaaaaggaaagattaagttgtataagcaaactctaaaaacatgaatataaatgcccctaacacgtaactacctcaaaccttcaattcttaaatatcagagaagaatcaaatattttcttggttttaacacatcgtatagatatttaaatatgtatttcataatgggaccattttaagtgtggctgtatttataaatattatttgagttgtcaagttgaggccaaagttaatgtgtgaaaaacagtaatgaaagccagctagccaaattgcaccacctactctggcaaaagggcataaaagaacacaaacggaaaccagaaaggagaaaatctatttttaaaaaactatttgaatgtcatcaccatcccaaatggatcacaaaagcatgttttagatgtgcgtgctttttctgtttttgttgttgacatgagtctcactctgtcaccaggctggagtgcagcagcgcaatctgggcaacctccccctcctaggttcaagcaattctcctgcctcagcctcccgagtagctgggactacaggaatgcactactatgcccagctaatttttgtatttatagtagagatggggtttcaccatgttggccaggatggtctcaatctcctgacctcgtgatccgcccacctcggcctcccaaagtgctgggattacaggagtgaatcactgcgcccagccccatgctttttcttaaattgtattggattctctgaaatcattctcttgacatacagggtccctctcttctcgatgactaattgctccatcctggcataaatacagaagcctttaaaatccacttttacctcttaacgagcatcgttgcttgattgggtagagatagtctgaactaatagggacaaacgcaatatagacaaagtgtctttacctcaccaggaggaatgcccacgcaaatcctgtcaacagcaggcttccgcttccttctatatatctgcaacaaacaaaatgtaaacattcataagcctcagtgactcacagctctcccaagcaactgtggaaggcaggactataaaccacatacactgcaacataagacttgtcaataaccctaagccataggcatatttgatgtgccaagagccttggtctgcgtttgtggcgactggcttctgaatgattctgaagctcaaaataaaagtgaacttactttttaacctgtctttttagaaccgtatcattcattattatctacataatttttcatctattcaacatatatatgtattgcaggtattttaaaaattaaattccacagagtagaaatttgtaataaaaatattgcaaatactgtacagattccaaaaaagtaaaatttggagatgctggcatctagagggctgatatagaccctcttgaacacaggcaatatatcagctttttggactatgaaactcaaactcaaaatcaaccatttattctctctacctcagttttgactagatatacaatattagtatgttttaataactaacacataaatgtaagcatataaaaccaatgtattcgagaatgggaattcatatcacaaaagaattctcagtaagaattctttaagaagtctccatggtgtttttaaaataaaattgacagaaccttggtatagatgtacattttgggaacacatgcccttttattaagcaagtcagcaaactgctgggttacagcacataaagctgaaaaaaactgaagatgagctattgtaacctgtactctctcaccttcgtcaactccttgatttctaagatgtcattctggcctccaccatcaagaattctctgtctttcccgcctcacatcttcatcttcatcattcagaggagatagctttgcatttacaggtcttgggggaaaaaacaagaaaaatgaacctttcaaactatttttcaggacaaagattcagtctctaacgtagtattataaaacctacttgccacagtctccaggatgggcagggagggggctgcgggatgcccacatcaggaaaatcagttttatcacatattttgagttcagttcaatgcaacccccattggtgagtgtttccctgtgcgcctcctctgtgaccctcaaccaggtgctccacgggttctaagaaaaagctcacctgggcctgatgaagaatctgtactggatcagaacagtaatgaggaagaacaccaccccttccacggccatggcgaagaggtttcgtcccaccaagtcccaagataatggtgacacaaagcgattctcccctagtagacacaatgcagagatccggtcagaatggagggatcaaaaaccatggcccttcctcaaatttgggcctatgttccttaaaattcaccgatcttccaataaacacaaatggctatcacccatgacaaggaaaaaagagtaacaagagagtgatcactttccaagtctgatttgggaaaactttttatgacccagtatcaatcagaatttcagagccaatgtgtattcgatttgtaacttcactgaagatatctagtatttctttttttaatgagacatgccaaaaatccttttaaaaaggcaaacgacccaagtaattttcacagtcagtatttttaataaattctaagttttagtaataataaatatcagaaagcactttaagcagattcccctttcagtagcatatatcctagtgaatcaattaaaccactagattcaattaaatctagttccatgtaaccattccttaaattccttacatatctcctttgtagcccaagttgcaaaaagcccctcttctatgaacagtaaataacatggcccatttgactatattatctaatggatgaataataatcatatggctaccggagaaatatttttaaccattctaaaggtagaaaaagatgtaatacattataattttatagactgtgtaaaagataataaatgacctcatctgcaggcacatgattcgcctaaaagagccaaagtttgcatctttccttctgattccctgatcacctaattctcaaagttatggtttgacttttccagtgcttctaaccaacccagacagtggcatgagccagtggatccaagcaaatgccactattttccttaccttcaaaactgccctttcacttttctcaatgctatcagagacacagacaaatggttgtgtcacaaaacccatgccacaaccagctgtgttggcatgagccctgtcactgggcatgggggtgggggaacatcctgtgcttagtcacctgcttctttccaaaacaaagttcagggtaccaaggcctatgcagagtgccatctccattaaagcatcctacagccactgcttcactcaccaaacctttccagggcatcagccattgcctggtttttcaccatgtcgatgagccctcgtcccaggcaaaaatgtgggaagatcaagaacacggacttcaggatatcattgatattattcagcttctaaaaaaaaaaaaaaaaaatgggagggaagggagggtgagggagaagaaacgggtgtcattcatggtttatcctaaaaatgtatcaagttctgaaatatgggagtgaagaaaaaatttgattctctagggacaaaccagaccttttaattcagataccaattaaatagcagcaggcatagctgatgatatgtagcaataaaattctattctttagaaaatctggagaaatgctctgagtatggagaaataatgaataaagcttagaaacaggctagatttaattaaagcaaatccattaaaaatcccttagcatttgaaaagcaaattgctcatgtctgggtcaatatttgagtttcaggattttgtcagaattttagaaattcttctcaaatacatcagaacttatgatcccacaaggcaacagtggccaaatatctaccaactgaataaggggctatacgctggatgcactgtgctagggcatgggagaggcaaaattattaagaaacagactccactccgagtaggaaaagtatgtaaacaggaaattaccatgtaagtggatgtacgttgtactggaggcatggactaaggactctgagagcacagagaaaagagagaacacctcccagcaggtaaggaaagcttcacattttagctaaatcttgaagggcaagggatatactaccagaccctgtgacagaagaagggcatttcaagccaggcctacaggagcatggtggttggaggcaactcatctgaagcttacagctgggaaagggtgtggtgggtatggacaggaagagttgtgcaactgtaaaaggccttgtgtgctgtgtttggacaaaggcaatgacaaccggaatggagaggaagccttattttagaggtccatacctggaagaactgacaacataaccagttgaatgtgggaaatctgcaacagcaaagcaagcatctaggataactctaagagccagcttgggcaaccgagtggatggtagtgccactgagtgtgacagggatggcaagaaaagcattaagttccaaggggaaagaaaactaggacatatccaggttggggtatctatatactatctaaatggagcaatccactaggcaagtgagaatttgagattagagttcaaggttatgatcaaggctaaaggcattgatcttagagatgacaataaaaacaccaagagaggtgatggtaaaagccttaggactgaatggcgtcgcccagctctcatgtgtaaagtggaaggcagaggagctactcttggtaagagcaacattgaaaaaagaaagaagtaaaaaaaactgtcaaaagaaactgaaaggcttgaccagcaaaatgtaaggcacagcaagaaagaaaggtgctttgccttctcagggaagacagactctgaagacaggacaaggcagtcagcagtgtcaataccactgacaagtggaataagatcacaattaaacactgtcctctggctcccagagatgctcatcccagcaggagtgttctctctgcatgactcacattgtcggtgaacagctccagcacaaaggtggccacgctgccattaatgccaatgaagaggttcacgctggtgagcaccacataggctgtgctggggatcttgaacacaaaggaggctgggtacatgagaggtgtgattgaccacctgttgagacacaaaaagataagtgtctactgagagtccctgccctccttctgacactgggcaccaaatgccttatccactgtgcagctccctcactcagaggtgacttacccatacagcaaaagtagaagggctagcacaggcagattggtggaggacacataggacttctgctggaagcagatgaagatgataatgaccagtgtggcagggacaacgtaattgcactaaaagtgaaaacaaagacatccagttcacccctaaatcaaatatacaatgcatcacacaagttttcaccattatcagacaagaaagggcagataaacatattggagagtaactctgaattaatgaagccacataaactattaatcaaaatacccgacaatacattttgacaagcattttccccttggctgattttataaactacatgccctttctgtctttccaacagtcaagccaaggtgtcacactcagtaaacttactgaacgatggattcccagtcagagtaattttaatttcacaggcagcaaataagcctctattcttcttcccgaagatgactgtgtctgtttcgtcattaatgctatattatagtctgcccaagttcaatctcacatgtaatctatttatgaggtaactgctcataacatgaatgtcagaattgtttcatcgcactgagaataattttaaagtctgtcctgacagtgtatcaagcagtaaaatgcagaaataaagacttgacgataggacaattatgagaattcacagctggcagagcaaagcaccagcagggaagtgatagtggggcttgtcagccgctagaagaactgcagcttcagactacagggctctgcctcagtccaatcctacttgatgtgtttatcaacaacttagatgaagacatgcttctagcaaatttcaggagctctaaagcagggagggacagataatacccaggaagacaagagatgggttcagggacttgacctttcatctctgaatcacctatgcctggcataagtcagacacacagcactcagtctgtgtttactgaaaggagtaattactgaatcaagataaaacaaaaataaaacccatgtaatttaatatggataaatataaagtttagtttcaaaaaaatcaaatgaatttgtatagaatgaaggagacccgaatttcacaatcatttgtgtgaaatggaggttttggtttaccactaagttgccagtaagacggtgctccttccaaaatgcaaaatctttgtgctgcagtaatagaagtgtgagctaaagatcaactccctctggacccataaccattcagaccacagcctgaacacaaggttaattcttggctttgcttttgaaaacggacattcacaatatacagcatggccatacaaggacaaccggatcagaagagtgacacagtctaaggggcttggtataaacagcaaagatctcatcatcatctccaccatcattgctcacatttgtacagtgcttcggaggttacaaggtgtattctcatatatcatcttatctgggtaatactcaggttaaatgagagtatgagagttatttttaaatatccagggacttgttcggtgggagaagaattagatttgctctgtgtagcttataattaatagaagttacagggagatatatttcagggagatattgtaaagtagagttgaaatataattagaacttcagaattccttcaaatcccccatattggtccaaatagaagcaatatattgtggctggcacaaaaacatatttgcaatggatggataagctgctgataaaatgtacagagttttcaaatgacagatggctttcctagtaaggcaaagaacattctgactctggaggttaaaacccatcagagaagttagaggcattgacttggagttttgacttgtatctctctgattcttgggaaagttgtcacataggaacttaagtggtagtggtattaattttcatcattgtgtacagaattttccctctggtgtgacatgaactctggtacccaatgctgtgtttggtgtcatgaaagtgatcacctgcctctggctatttctttttcatacatctttagagtagctggaacatttcctgatgatagccagagctctttctttcttatccatatcaatccatggccctgacagacatcagaaagatacagcaggcctgtgtccttaccatatcccagacaaaattagagagccagtagatgacaggcttcactccactgatgaactgcaggtgttttgctttgctgacccgctcctggatcaggaatacgacaaagctggctgggacgaaggacattgcaaagatgacacagatggacacaaggacatccactgatgtggtcatcctggagagaaaaagcgtgtgaaaatctgaggggtctttgatgcagttagggctcaatcagtgaggacatggacacacagacaaacacacacgtacacacacacagagatatctgaggcacagcccaaggaaaaacatctgttcaccagacacattttattcagggttaagatgatcatttttaagtctaaaaatatgacaatgtaaatgccaaactggtattactgaggtcaaaagagtccactgtcacaataaaactaatgaaggaagtcagagtggttaatggcattcactttggtccactgttcatgaccttgtaagagcagtaagttgtaaattttcacacacaaaggactagtggggcttgaaaactaaatgagagcagaaatattactctgtaactactcaaataaattaatatttctggctgtaaatcaacttgaaaataacagtatgcagcctattgatctaacacatacaaaaattctgtcagatttttataagaagaatggtctcataagcccattacatggggtcttggtataaagatcctagtgtcctatattagtatcctgtaggagtaaagcagaaacaggaactgccatgctccacatacaggaaaggtatctaatgtgtgtgaaatatcaactctgtgctgagtgctgggcttggcaatttacatgaactgcctcatttaatatcatacatctataaagtttagagaccagattcaaacccagatctgtatgactccaaaggctgcatactttaaactagctcatcctggctttaaacttcacacacacacacacacacacacacacacacacacacacacagcttaatttaggaattaaagatacaagctaataaaaacatattccaccaaatttaaaacagtggtttttaaacaaatcaaactgattaaacacttataattaaattataatttaattaacaatttttgaactcactttatatgaattcactaaatgttacgatttttacatatcagtgtcattttctcttctgcagttcaagaagcccaaccagccaattcgtaaacttatcacttctgcccagagcctggatcaatccagatttatcataatataacggtctctgcagctgttcccctacaatgagattcacatttttctccccttctccataaccctctcccttgccccactccatctatacagacacagccacacttacagagccacctctgagagctgctgcttggtgagattcaggggatgattgaaagcagtaattccataatggctagggttctctcccttttgcaggttggcccggagaatggcattgttgatgacattcaggaaagagctgattgcatgccagcccttgttattgaaccacacctgaaagaaaacataccaggtacaaggtaatgcccccaaaccgggctcctgcaggcaggtgcatacccaccaaccatgcccataaacctcagaaagaaattctagtcacataccaaggcaaaacactatgatcagagaatatggcgaagtaattacagtgttcaggacatagtgatcactgactatgtgggcaggcgctgtggtgaggaccttatacctttaactcattgaattctcacaacagtttggaaatagctatgattactgtctccatttcacagatgagggaactgaggtttagataggttaagtaacttagtcaaggttacctggtatgtctggtggcaaagcaaattctctgaatcactacactacaccgtactgcctcactggtaaagttaatagtttgctcttttctgttgtgaatgcccctgccaactttaccatgagttgaaagtactccaggaaacataaggattattgttcatcaaaaagctactagaacaaagacagcggtttaccttgacattatttttggtgtccagtcctgtcataaatcttcccaagctgttgagaaatcgatctgcagaactgtcctgtaaacaacagaaacctgcctcagttgtgactgttcacatagataaggggcaacagtcaatctggaacctgtggacaacaggacggccctgtgaagagcaatgccactaccttgttcactgaaattaaatgtgaagccattaaataaacggctcctgagaaccaagtgactagaaatctacagcagtgatgctgccatgatgccacaagtctagaaggaatcacagagaaatcctgggatgcaaagccccaagattttaatgtctggttatcacggtggggtgaggactcctcaaagtgctccaccggcatcatctgaagagccagaaccacgctctgcctgcagatgtgccagatacatgggcccatcactcaaaagcagacttgtggactctaggactatcactgctgtccacaatcctagggtctgttttatcagagccccttaattctcacctaaaaatgggaaacctgagacacagagaaatgaagtgagtacttatcaggtcctacagaccagcttgccagcttaaaaaaaaaaaagattcatttcctatttagtcagtgattgtttcagcaaagtatgtttgaaacccagtttatttaccaactgaccaaatttgtaaacctggttgttctgagagctttttttgagatggagtcttgctctgtcgcccaggctggagtgcagtggtgcaatctgggctcactgcaacctccgcctcccgggttcaagtaattctctcacctcagcctcccgagtagctgggattacaggcgcacgccaccatgcccggctaatttttctatgtttttagcagagacagggtttcactatgttggccaggctggtctcaaactcctgaccttgtgctttgcccgcctcggcatcccaaaatgctgggataacaggtgtaagccaccgcgcccagcctctgagagcttttaaatctctggatttaatttgttttttgagatggagttttgctcttgttgcccaggctggagtgcaacggtgcgatcttggctcactacaacctcttcctacagggttcaagcaattctcctgcctcagcctcccaagtagctgggattacaggtgtgtgccaccaagcccagctaatttttttgtatttttagtagatacggggttttgtcatgtaggccaggctggtctcgaactcctgacctcaagtgatccacccgcttcggcctcccaaagtgctaggattacaggcatgagccacagctcctggcctctggatttgtttttgacctacacttttaaacgtacaactaagtaattcagttttgtctggctcaaatcgctaaatgccaaagacggctctgtatgccaacatattcagaacaatgagctgccaggtgatccgtttaacctgccaactactcctatatcccagcagctacatgcccatttttctgatacatcttacgatagatattttaccttggccagctttaggtgtttcttcatttgtttgatggcatcattaacttcttgactcggaggaagtgcttgagtattactgacacccagggaaaagccgccatacctaaaagaacagcctgacattaaaacccagacagtggggtgcacagtatcatcagcagcagactcagtgcgagtgtgtacaaggttcactgagtcaaattcctgttcaaaggagggctaaattttgcctcagagaagttacacgtcagcttcctctaataaatgttggcaatctcttaactcccatggtttctgcccagcagggaggacctggcctgattacacacacagttagatagctgagacattgaggaaagaatggtgtttcatctcacagatgctcctccaacccagtggctcgtgtgtgaatgtgggtctggaggcaagcagatggggagttgggagagtgggaaccctgcactgtccagagtaggctgcgctggccttatacacaggctccggctcctttctagcatgagggctattataggggcctgcgtctgctctgcccagagatccaggggtcctggcccttggggaaaaggcagagagaaaagacggaaatcagtaacaaggagccttcgggccccctgacgtagccacatcacctatctcattttccatgatggacaaactggcttcaagaactcttctgtccccagtcccacctgttccttcaaaacccagaaggacaaatgggttgaaatacagtgcaaagagatggttttggcgcttcttatttcctctaagacctttttagtcccgtgctaaatgcctagaaattgtccttgagtccttaagaagcctcgggaatctggtttggggggaaagtacaagtaggtattcccctcacaacactacttacttgaaatccctagacacctgcaggagatttctgattctcctcaaggaaatcagtatatcaaatatttcagaggcctctggaggggctgctgggcactgagccatgatgctctaggcagaaactctataaagcaggcctaatctaaatctgtctgtgcccctgtgtgctccacatgttcacagggcttctgtcctcctcacagtgagatggcacccacaagtgtgtgagtgacaaacaatccccaaggctttcttcaatccaagacacctacaacaccatcctccccctgagctaaacgtgccagaaagacagcaacttacctaaactcattcacccagatcttgttctttaagctgcagagacaaagaaacaaaaaatcagttcaaagaaagcactgagcctattcctaatgatgcaaaaggagtaaatatccacctgaggatataaggaacggacagaaataaccctagaatcagctggccttgtagggttgtgctagagaaaagaagcctgtgttcaggcctcttccagccttctctccatcataaataccctattacttatatgagaaccaggccttgggttaaaccaatttacaaaccaccttatagaccaagatgtaaccaaactagaagctttttctttcttttttttttcttttgggagatggtttcgctcttgttgcccaggctggaatgcaatggcatgaactcagctcactgcaacctccgcctcccagattcaagcaattctcctgcctcagcctcccaagtagctgggattacaggcacgcaccaccacgcccagcttattttgtatttttagtagagacagggtttccccatgttggccaggctggtctcaaactcctgacctcaagtgatccacccgccttggcctcctaaagtgctgggattacaggcatgagccaccgtgcctggcctagaagctttttcaattaacaataatatttcaattgtggatgacatatggagaaattatgcttctttcttagaaactcatggtcactatcactccagcatgcccatgccatttaaagtcactgagatactcctaactgaaagaccccaactgaccaagttgatgggaaggaaacgagaacaaacatttgctgagccaagcattcaacactaggctgccatgtcctgggaagctagaaggctctcccaaggctgcagagccaaggcaggctcctaaaccttcccagagctccctccatgagaccacaaattatcatggagtcccccatcagagagtacccaaggcactctatgtacaccatttaatttagtcctcatgacaaacttataagagcaacattaatatcacaatttagataaactaaggctttaaaaggataaccagttacctggtcaagttgctactaagtggcaaaatttgacgttgaatccatttctattttcattctagaccaggctgcctcagccttgaagctgacaactgaatgttcacagtccctctcgtcatcttttctagtttgggataatatcctaaacttccaatagacagaatcaggccataatctggcatttcccccactgtttcagtctgttatttgtaggtctttaattcctctaattagtaataatacggcaggggccaagtttagtaaaaagtcaccttttggctatgatctgcacatacgtcttcaccagataatccgaaatgtttcttcctgtcaggtcctgaaggatatctgcagtgttttgttttctctgtcatcacatgaaaaccaagcatacgggtctttatagacaagaattgaaacagaaaacaaatcaaggacaacagtgaccatgtccacagtgtgaccggaaacctgactacaggtcccagacactgccctcagtcaaccagcactgagacttggttcaccctgccctcggcactggtaattcacttacaccaagccaaggtctttcccaagaatttattctgaacatctaaacaataaacattgaaatgagattctttgtagtcaagagatttttaggaagcaccatcattcactatgcctaataaatcttctgttcactggagttatactgatgactagattagctgttattttattcattttattttttgatatggagttttgctgtgttgctcaggctggagtacagtggcgcaattttggctccctgcgacctccacctcccaggttcaagcaattctcctgcttcagcctcccaagtaactgggattacaggcatgtgccaccatgcctggctaatttttgaatttttagtagagacagggtttcgccacattggccaagctggtttcgaactcctgaccttaggtgatcagtccacctcggcatcccaaaatactgagattacaggtgtgagccaccccgcacctggactagctattattttcaagagtggtaaccaagccttcttttagttcctgtactcatttagaattgcttgtcctcatcctgcaatttggttgctgataaaagcagcagagagctatcataagcactcctcttcctgaaattctcaagaaaaaaaaaatggctcaggactccttcccaaacagagtctctaagaataccagagttgacaagatccacaggagttttctggtccagcctccctaattcagaggtgaagaaacaggcccaggcctgtcaaaggctaccagctcatttgttgcagagccaagattggaagccaggcctgccacagtctgtcctgtgactttactgctgtgggacaggcatgggcacagtgtggtccaaaccttctcccctcaaaactcacatgctttttcttatgacaagaagcgagttaaagactgaaacagggctgggcgtagtggctcacgcctgtaatcccagcactttgggaggccgaggcgggtggatcacctgaggtcaggaattccagaccagcctagccaacacggcgaaaccctatctctactaaaaacacaaaaattagccagacatggtggtgcgtgcctgtaatcccagctactcaggaggctgaggcaggagaatcgcttgaacctgggaggtggaggttgcagtgaggcaagatcatgccacagcactccagcctgggcgacagagcaagactccgcctcagaaaaaaaaacaaaaaacaaaaaagactgaaacagaccctcccaacatgatatctcactcattcctgcttccaagcggaagctaccagcccatcctgcaccccttctgcccaatcaccccctgaaagtgactcacttgtggaggaggcagcccccctgcccctgggggacacacaggcagcatcttcttgattttgtcgctgctacactggcatgcaggtgaagggttctgcattgtccagttcccattctggaagaggtccatgatggtctggggaactggggcagtggtccactcttcctcccctgcctggcagggcgtgtctctgcaaagggaagacagcaagagtaggattaccagagatggcctggcctttctgttgcctcaggagcacaggatcattccgtaacaaccacaaacatgcatctattccctcaccatttggaaaagacaagcatgatctcatttgattgcttgatcccacaacagccttgtacactgtgacatcatttatatcatcattatgtatcattttatacataagtaaaatagaatgcaaagaggccctaaatatttacatactgaactcagttcaatccaatcaaccaaccatttgctcacacaacaaacattcgttgagcatctactacgtgccagatgctgtccagtatattcgagggcctaaggtgaaaatacctgccttcatggaggtgtatgcccatggaggagacgaacaacaaatacactaataagataaccttagatggcccaaaataaagcaaaataaaaagacagtgactggggagaatgaacctactaagagaagacatttcagccaaaacataacaatgatggagaacaagctgggcaaaagcttggcaaaaagaacattctgagcaaaagcgatggcaagtgcaggtacaaaggccctaggaagaaatgcatttctattttttaggaataataggaagacagcatggctggagtaggataagctacgaagaagagtaatgataaaggaggaggagaggagccagatgagagaggcctgggaaagagtctggatcttatgctcgatgtgctgaaaaatgagtagagactggcaagatccaatttatgttctcaaatgagtagagaattgggggatgactggggtgagaatgctcgtcacataaagagctacgctgtctacaaattttccctggagataagacacaaagccttcaacctcatctccagctctgaattactgtgggacatcagcaggtcccctgctcttttgggggcttattttttccactggcaaaataaaagtttaaaatgatttgattcaacaagtcatttccagttcccttccagtttcagaattccacaatttaaagtaaagttacagcaattatttccttattattaaatattaaatataattgccaggcacgatggctcatgcctgtaatcccagaactttgggaggcgaaggcgggtggatcactaagtcaggagttcaagaccatcctgtccaacatggtgaaactccatctctactaaaattagaaaaattagccagtgtggtggcacatgcttgtaatcccagctactcaggaggctgaggtaggagaatcacttgaacctgggaggcagaggtggcagtgagccaagattgagccactgcactccagcctgggcaacagagcgagactccatctcaaaaaaaaataaataaataaaatatatatatatacacacacacacacacacacacacacacacatatatatattataaatatatatttttaactatttcttattgttttcttatgtattaaaaattcaaatgaagttttccagattgatctctaattgtctccttaaagcacctgaactgaccagaaaagtcacactaagacgcgctgccctcctgaagcttacactctgaacattcaaaaggggattggctgagacaaatttaaatacagctgagacatgctcctgtcaaatttccttcaggtccaccatttttttgcaaaacctaaaaatttgaatttcagtaagaattgtaaggataaaggctcttccttccaaccacctccggcagactgtaggtggggctcagacatcatgtttgaaccctctgatgtcagggccgggcctcttttgtctctatgggctggctctcagcccagttctggctcctacagagccttcctaagctagcatcaatccatgagttcatatggttcagctggccagtgatgaatccagataactatattatcatctcatctcatgcttctatcttccctacacaaccttcatgtggaaaatcaaaggcaccatgaaatccagataggccgtgtctgtgtccttctctatccttgtcatctggttatttgggaaccaatattagctgctaggatttaccacccattatgtactaagtactaacaagtatttagtaactatccaatactaattaagaacaaacaagcacacagtagctatccatttagaaatctgctctagaaccttgtataaacaggttatcatgctcactgttctgtggtgtgcagagtcacctatcttcccattgaaacttgaaagtcaagtttgccccctctccaattctccagcaccttcccaccttgccataatttttcagagatcactgttgtttcatgacctcagctgagattctgcctaaacctggaaacactaacccacctctaccagccttgagcacggcctcataagatcctcacctctccaccatcttcactcacagtgatctggtgacctcccttcccctacactcacttaagggtcatatggatgcttcactgaatttatttatccactgcttactttttaaaagggggttttgaaggaaagtacaataaaaatatacaatttgagaagaagaaagtgtccctttttataaaaattcatatgccatcttttcagattataaaagcgaagaagctgataagcaaaacctaaaaatcatatataatgagagcctattgaagcacttaagtacaggggctgggagagaaagaaaggaaaagcatttcatcagtaagtgtaaagtgctatttaaattaaatattaaggttctaaatcagtaaacaaatgtctgtaatgacgtgctttgcacggtgttagaagactctccaaacgtttgttcctagataatttagttcggttactaccttcgctttttgtaaataaaacataataataattcaaagggcaaatgctggcggtcacaatgtggcatgcagttgataaatgcagcatattagaaatcaaaccaggcaacaagcacaagaagcctgcttatggctaaagtggcactcacgggattgggtttccttccatacagcgggtcccgaagccagggtctttggtgagggcgtttaagagttccagggttcccgtgtcctcaggagcatcattgctgtgggtacatgagaggcagccagcttagtaattcattaaaaccagtaatcgagagataaaaatgtttttataaattaaacattttaggaagcatttctctgtgacaggctcttaaaacagaaatgaacaaaacacagaaaccacccagaaggatctcagactctggccctgtattcggcatcagggtgacgtagagcactccaaagtggagcttgttttaaatgggctgtatgtataaaggtgtgtatgtgtacacacatgtacatacacatatacatttatatattttttttaatttgaagaaaatcaactcattaagtatttcaaaagtgctttcacaattatccctttggcacagacaagcaggattttccaagaaagggcaagaaaactttgtactctttgcatgcacaactagaaagcacaaaaataacaggcacaggtcacaaacacatgctatgttccacaactacgggcaatacagggtcagcagccggaaaggaaaaaataaagtaaacctgaactatgtaagaagaaaatgtgggcttagagaaaaagaggccaattcacattacatatatatatatatatatatatatatacttttttttttttaaatgcttcccttttgtatcactgacacagttcccccatctacaggtctacaaatctttcaggactgaagaaagctcctgctaacaagacccagaaaaatcctttgtccttttctttgatttaatgtattgttacagagtgggggatatttttatctaaagaacaaacactacctaacatcccaaatataacagaatagataataattacatgaattatactttgcagaaaacaagtctctggaggttctatgctttgacagtgtgccctgtgactcagttacagaattaaaacacagctccacaaatccaaatattttataacttaatcatggatttttgcaagggtggattatttcacctaaaacacatgtggctgttcctgacaacagtaggatgaagaggagagaggctgaaaggctcaacagaagactggcctattattcagggttagttcgctgctgttctatgcatgcagtattagcttatacagggacctgagccgcagcagtaaaattcattccaccgtgtaattctgaagtccattcccttggccctcgtaaacatctttggtctgctcgaatcttaccccctcctgggatgtagaagacaaacatacctgacaaatgtgtactgttcgttgtacatccagggctgaagttccaggctggggtacttgccaaagggtggcacgatcaggctgaacacaagggcaatgcagacaaacacagctggcaagacaatctttacccaggcagtggagggggcagggggacagcaggaaacggcaagtgttagaaacaaggccaaggggcaaatccctacgagtccagcccacctccccgaccaaccagcacggcaatgaggaatgcagggcctatgactgtgctgcaccaaggcattcttggcagctgggaagcaatggagcctgaaaactaaaccttttctctggcaacacaaggccagaggttatggccacctggcagaggcactaagccaagaagttcacgaagtaaatagtgctcacattcagggtgactcagaacactgggtcctgcccttcctcctcctgaagactgagaaagactacattgggccatgaacccaggaccaggagccagaagtcctgaatcctggttctgtctctagcacaagtgtacccatgtgaagtcacgctccccactggcctcagttttctcattttaatctgaggtctgagaacacatggcccattcaaatcctacactataataaaaccaactctacagcaacggctccaatcatggacaaccatagtcattatctcccatgatagtctcagaaagaataaatatccaattccttcttcaacctcctaagactttctaccatatcttctctgaaaaaaaaatgacttgggtatactttataagttaacccaaaactccttccatttattgctgagaaatgtattccttataaccttaaagattcaaataatgcccccaattctaatgttctgggatttcaatgcagaaaattaacattgagtgaataattctgtataacaactactataatgagaactatctctatgttgtcattatttatggttgtgttatcaatggtcatcatcaacaaacaaaggtaactgaggatcagagagactaagcagcttgcccaaggtcatatagccaataagtagcaaagtcaggattcaacttgagctctgtatgctccaaactcccgctcttaacaatatccacatcatcaaatgaaagactctctgcagaccttttctctatatttcttgattttatagagtgaaaaaatttaacctttctaactaagcaagttagcatgcaaacactgacatgcagacaatagtctaacaagtcttctctgttggccaactatattctgacctatcttttctatcagtttgagttaaacatcaactcagagaaaaatcatgtttctaataaattcacatgtcaagtgcatctgggcataacaactctcatgttatgacagctgaatacacccaaccagtttttctacactttgtcctttttatgttctcctccaaaataaaaataacatatacacacacaaaactaagcacttactaatgtcaggccccattctaagcacctattcatttttattttcgtaacaaccctgtattgcaggtaatattattatccccattttacagatgaggagattgaggcatagagaagtaacttgccagcggatacacaactggcaaggaatagaactgggattgaaatacagataaatctggctccggcatccatatcttgaccaggatgctatcctgccttcactggtcacagagcctgcagcccacccatgaagccagagtctctggcgaaaacagcacgtctcacctgagcaaaaaatcctttccgactccgtctggcaattagcagtctcttccacaaaagggccacaaactgttgctgtgtaagtttccagcctttcacctggtaggaccctttgccatccatcccactgagcaagtctgtctctctggattctgcaagaagccaacactgaaggtcacctattatcttaggtgttttcggcattgccatgctccttcttctggtgtcttcaacaactatcttgaaggcatgtgtctgaagctagaagtttctcagaagtaaagggctttcatgacaaagctatgtccaaggaaaagcttgactcaaaatgtctaacagtagcagtctctgcctttcagtccttgtctgataagtacagaaaagaaaggtgtcttgagacaactgaaaagaggtgttcatgcgtaaccaggtgttacagccagccattcggatgaatcaagtcatcaatttcttatagactactctatgaaacaggccatgtacgtagcttgacatatttgagaatacacaatggcaattagcatctcagcttctcaccctattatattttggtaaaacgtggacacatttcaaatgatctaagtactgatactgtatgaagtcaggcagttatatataatgtaagagccatacactctttgagcaggggtgagagaactggaaagttttctgttcctaaaaattttctagaaatccttgtcctaaactaatgatacctaactgatgtgcttttacatcttaacaatatttgtttgatgtcttagctctcctctccatctcagttaaacacacaaagacacactcatccaaaatatctaattctttttttttcttttttgagatggagttttcactcttgttgcccagtctggagtgcaatggcgcaaccgtggctgactgcaacctctgcctcctgggttcaagcgattctcctgcctcagcctcccaagtagctgggatgacaggcatgtgccaccacactcggctaattttttgtatttagtagagacggggtttcaccttgttggtcagactggtctcaaactcctgacctcaggtgatctacccacctcagcctctcaaagcgctgggattactggcatgagccaccatgcccagcctcaaatatctaagtcttagggtacaattaactctaacagcaaattcccctttctgactctttcaaaatcactcatctactcgaatgaatatttgttcaacaattaaacacctaatgtatacaagaaactaggaccccgcagaaaagataataaatacatgggttcagaggattgaggcaccatctttatgtctttaaaggaagtgatatggataggctctttcaggtttgatcacatgcacgatgctgcaaagaacaagtggcttttaccatttcctcacttctctttggactctgtagggatctatcaccttggctaaaggccatccaaagaaaacaggtgagagcatgagagagaatttcacattcaaacagtaggacactgtttgatcttgccctaacagacctgggtctatgtcagaatcatttggatcagcagcatcatcttcagtgaacgggcgaagacagctctgcttgtccccgaaggcccgcctgtttcgtcttgctggcaaggtaccatctgaaggcacaaggaaagaatcccatactttattttatttacaacaaaacaaaccttccccatctgcaacaaacctacactctacaaatgagaatgcaatagaacaattcaaagggaaaggaacaatactcgtgcactgagaaagccagcagaaggcactatcttaagtgtgccattctccctcaaggcagttacctgaggtctcagcatccaccccactctcttcggccaccttgaggaatatctggaaaatgagagagatgagaacattataagcaccaacattacgagagtagtcaccactgccacgattattatattactgagtggcatgttagccccgtaagacagagaaagtagaagccacatttcttaataacactttctcagagttacctgggagagaagccgtttttgccagagaacatttcctcagtggtgagagctatcaagctagacaatcattttcaaattaaagttatggctgagcgctgtggctcaggcctataatcccagcactttgggaggccgaggcgggcagatcacctgaggtctggagctcgagaccagcctgaccaacatggataaaacccatctctactaaaaatacaaaattagctgggcgtggtagcacatgcttgtaatctcagctacttgggaggctgaggcaggagaatcgcttgaacctgggaggtggaggttgcagtgagccaaaatcgcaccactgcactccagcttgggcaataagagcaaaactccagtctcatcaaaaataaaaaaaaatttaaaaaaagctatgacagacactgcgcagaagaaatttattctgaacctacagggaatgagtcaagtggcttctttcaggactgtggctctaaatctttgagtaggctagtactatgataagttatccaagacagaatgagcaggaggaaatagagcactagaaatatgatggcagcaattcaaacatcagaagagaatctgaatgagcgcaatcatttccaaactctagtctatagaccactgtgtccaaagtatgcaatagaaatacagacttcaaggcctcacctccagaaattctgattcacaggccctgaagccaaaccttagtatgtttatttttaataatatccccaggtgattctgctgcactgtcaagcttggagaccacttggccagacagcttttatatccccttcagccttcaaggtctgtgatgttgtatctctaaggggaggcattacatggataaagagaggatggactttgaagccccaaacccctgattctgaatctcatgtcagcattcctgagtgttcattttttcatctttttttgagaattaaatgaggtcacagtgattaaaaaaaaatcaaaaaacaaaaaacaaatctcagcacctggcacaagtagactatccatccataaacgtttgtcatttcctatgtatgagaatccagttgatacctggctgtgacacagtcacaccagagaattgctcctgattctgattcagtaggtctgagctgggcccaagttgctgaatttctaacaagttcccaagtgatcctgatgccgctgttcctcacactgtacttaagtaaagaggctcattaaagggtaaataagtgcataggagtttaaggttgggatgtaaatgtgttaggtaccactggtttcaacacacaaatctcaggcatgtactgtggtacagaggaaaacacttctttcctgctatctcccactaccatcttaaatggctcactggggccaacattaatcagatgtcgatgacctaaaaactcaatgactaactccatgataatcctgctcccaatgcaggctactggtctggccttaggacatttggccttgctatatattccgacagtcagccacttaacttacttcttccagggtcgtctctgagatgccataactagaaatgcccaggtctgagagccggtcatcaatctcatgaaagagttccacaaaggctccctccttagcagcttcatatggcagcacataggtcagctcatgccctatgtcttccaccagccgggcttcagacacatgcttcctgatgaggttggagatagcagagacatctgcagggaccagaatgcaaagatggctcaatcaactcagaggggcttcggagtgagggctggccatcccccaccctctcatcagaggcctgccgctcatacaccacacctgttccaggtgtttaggtcattccacatgttcatctctggtctgagggttgggggcaaaggaaaggactatgtcttattcacctttgtatcaccaaagccaggcacattataggtactcagtgtagaatgggtggacagctggatgggtggatgggtgaatgggaggatgggaggatggaaggatgggtgggtgggtgggtggatgggtgaatggataactgaggctcaaagtctggtgtctattgcctaagctctgggattcttcaaaagaaaacttgagtaaaggaatcttaaaagattcttcaccctttcctatgcttataaagtaggttccctcatttacctaaataaagggttaatctaacagtccatggaagcagaagccttcctgggaaaagccagccattaggactaggcagagatagcaagggtcaagacttctgttccacatatgctactggtgacactggcctcctacacacgctacccaagaaaaatctggaaggctgttcctcatctcctgggctctcactcttcttatgtactaagctcaaatcccaccctcctggcttggccctcagctcctcatccctggtattcagtgtccactcccctaagggattccccaaaccccaatcatctcagctctctgggacactgccctgctagctcccaaaccgagccccaggcaccccagcaagcattaggccaacccgccaccaagctgctcccacacccgcagccacccagccccagcccagcagcaaaccttgagtcagcgccaccagcctctgcacctctcctcctctgcctccactctgcccagctgggggaagctcaggcaccacctgaataagaaaccccagagtccttaccgatggtcagcgtgtcactctcatggtcgctgcccaggccagcatcagaactgctctgagaaacactgtcctcctgatggcaaagaaggaggtgagaacgggtcagggacggagcaaggcagagccaccagcaccttcgccggggagggcttccaagaagctctgttgtgtgagaactaaaggaaaaagctttccctgggacacatgcactggcagccgtggcttcagaggaccctgtctggcatgtgtgtgccgtgtgaacagcctcgcttcctgagggtgaaaggtcaggaagcagagctgccaaaagaactgtggcctgccaatgaatgctgcaatgaggcctttgccaaccatctcaggcaaggcctttacctggctacatgtctagttcaatgcttctcatgctttaatgtgtgttcaaccactcaagaaccttgttaaaatgcacagattctgattcggtaggtctgagctgggcccaggttgctgaatttctaacaagttcccaagtgatcctgatgctgctggtcctcagactgcacttgagttaagaggctcattaaaaggtaaataagtggataggagtttcaggttgggatgtaaatacattaggtaccactggcttcaacacacaaataaatctcaggcatgtactgcggtacagaggaaaacatacctggtaattgggtctggtcccaccactgttatttacctgctgggtgaccttgaatcagctaccaattccctacaagcctcacttccctcatctgggataataaatatagttaccttcttcccagggtctctctgcactttaattgagatgatagaggttaaaaaaaaaaaaaaggttgtaaatggtaacaacgctatataaaattaactattatcattactttctttcatgcccagagtgtctctggcatgaaatcagtgcctaataaatattggctgttttatagtttaaaagttaaggtcaatgagattgaaaagtaatgagcaggaacaccaggtcatttgtagccaaggctcttacctcttgacaagtctcttttctttgacataataatgtcctctaaggaccttctccatcactctctgtgcctcataggaaaaggaaaacgggattcaacagaactagcacaatgggagcagagggccccttagctttccatgccttaagtatgatatgatttcaaaggggcaacagagcagggagatggtggtttcaacatggcaaaaggggtggagatggagaaatcattcacagccagcaagtcctggctgcccagacccaacaccagcccagcaccaagactgcagctcacctttttcaggtatgacacagtgctactactgtttctgcaggaactgagggaggattccacatctttcttgaccaaggtcaggtagtagcctgttcccagctggttcttcagaaacagggaggagcccacacagcacagcttcccatgggagatgatggcaatcctgtcccccaggacgtccgcttcatccatgtggtgtgtagagagaataatggtgcggcctgccaggcacaaacacaaggatgtgggacaggtgaggcctctcagttctgatttgtcacagtgacagggactagagagatattagcaggggtaagcactggaagagacctggaagccacctttcaccctgtatggctatgacccctagaatggcaaagctttgtatatataggtaccacatcctcacagaggtaagaacagtagcattttatttgggaacttgctatatgccaggcattgtgctaggtggtttgtgtgcattctcatttaatttaatcctctatgaggtaagcaccactattattatcggcaaagaaggtgaggcaagttgtgactttcccaatgtctcagggccagccagagttggctccaagcctgcctgtgctcctcatactgtaccacatcagatctctaaccagagagcccaatcgtcttcctgcccctctccgcttccattcatttaagcatccaccctttcaactaaccataaatttagtgcaccatgttggggacaaaaagatgaataaagacacagcatctcctctcaggaatctcagtctcaatgccctttatctcttctgtgataacagaagagtatcccatggcttcacagaagcctagccatgagatacagccacacttctcaaaagccccccgctctctctcagtccatttactcagaataaatacacatcaggcaccttgtcggtatttcagcagcagctcccatattcccctgcgggagtaagggtccacaccagctgtgggttcatccagaatgacaaccttagatcccccgacaaaggccaaggccacagatagctttctctgcattccacctacaaaaaaacagagcaagacaaactccaggaccagccccagacagtgagtgaaggcagaggacctaggggcacagccagggacaagtttctgttaccaaccgcacccagcctgggaccctggggcagtgctgattttcctccgcatgtgtgtagccggaggaggaggggagagggatagggaaggtagctctgggccgcacctgacagctggcttgttttgcttttcagcttgcttgatggcaaaccaacatccagggccatctgctccatctccgccttcacgtgcttctcagagagccctttcaagcgggcatagaaccagatgtgttcttcgacagtcagcctggggacagggaggcaggtcagctctgggccctactggataccccagaatacagtgtcccctggcccagaacagatgagaatgggcatatttttctctccccgtgctttttaaaataactttatcaatttctgaaaaataatcttcaagattcaaggtagaacaacagtgagcaaccacatgagctgctcaggaaatcaaagtgaaaggtgacagatcgcttccaacctgtttccagcaggcctggccaccatgcaccaggcagttacaactttcaatttcagggccccaagatgtggtctttaatgggctgtccccacagcacgtccaccaagaagtcagctcggcactcacctggagcagccttcctgagcctcaggggacctcaggctctgaaagcggggaggaccctgcacatgagccccatgtgttcactttagatgaggagggagcacatgagccccagctgttcactttagataagaagaaacataagggaaaagccttgcccaagattgcagagctcaggtctctctctgctccatcacacgggctccctgggggccttatggctgatgggacaacctgagtgggagcaaatgtcttaagcagcaaatataggtccatcataccagggccctgaagcactaccaggtctgggaagtctgctccaggcctcaataaggagggtggcgggggagaggatgggctaaagggccctccagcatgacaataatgggaagcaatgtttcccaagcccccatccactggctgggctgatgtcacctctacagctcaaccattcacctcccacttctcctaaaatcaaagaacaactaggtctcaaggtgttcacggaggtgagcctgccatattcaaagaaagtaaaatgtggccagacacagtggctcatgcctgtgttcccagcactttgggagaccgaggtgggcggatcacgaggtcaagacattgagaccatcctggccaacatggtgaaaccccgtctctactaaaaacacaaaaattagctgggcatggtggtgtgtgcctagagtcccagctactcgggaggctgaggcaggagaatcgcttgaacctgggaggccaaggttgcagtgagccgagatcgcgccactacagtccagcctggctacagagcgagactccatctcaaaaaaataaaaaagaaaaaaagaaaaaacaaaaacacagcaaagtaaaatgcttaagtcccactcctcccatgatggcatgacacacacacatccagaaaaggcctattcttaacgtgctgctggtactcacatgtcaaacagcacgttatgctggggacagacccccaggttctgccggatggtgctcatctcagagcgaatgtcttttcccaggatgtaggcggtgcccgaggtcggggggaacaacccggtcaggattgacctgaggacaaaaatttagaagtacagaagtcagggttgacctacccttaactctagatgctccattcagtctgcagagagaacagaacaccaaccctcccaccgcccccattcctttctaatgaaccctaccagacccacacaaagcaaagctgtccttttgcttcggtaaataactacaagtgggcctatgggttagaaatgccaattttagtatgagcattttttaaacgaagtttccaatctgcaatgaaagtattctttaaaaaatgtattttgtatgcctaacatcgcatgcatggaaaatggacaaacaagaacatattattcaaagataaaaacaatttttgtgttaggtagtaggatttctgactgccttttaaaaatcttctgaaaagctcataatatattaattctatgttttaaaaaaagattaaaaagaaaacaggaaaagaatgtcaccccccaaagatataccctttggaatggttagaatggttgaggaatcgtgctggaagccactgaggctaacgctggtgctttacagcccctgacccctcctgatactacccactgtaaggtccttgaggtcgcagggaaggcaatcaagccagctgcccagcttgattgcgtctcacaggtgcttctcacatctgcttagagacagagttcctgggaattaccaactccctccaacatatgtaatctatcttttcgtggctgcaggttccaagaccactgcagaattctgtgaactacatgggaaaggtcatctgaggccccagcttgttttaggctgaagaaataacatctagcaaactagcacgtggaaagacactcatgattagataacatgttcacattcggcaactcctcatgtgctccttcccttggcccagggatcagcatggtttcctaaggtataaatttctaactctactgcagaaccctcctgtggctgattctgcgggaaccacaccctcttcttacatggtggtcgtcttccccgctccattgtggcccaggaaggaggtgatctggccctcataaaaattcagtgccaggccatcgacagccaccttcatcccatctcggtagacttttaccaggttctgaatggacacgcccagcttcaagtgggtgggttcctcctccatgcagactgtgacaggagagaagacagaaatgaacccacagaaagcactgaggagtggagtgtaaggacacagggcactgcgcttgaactttcagaagtgccttctctccatgtccaccctggtttctcaggcaggcaggaggctataaatgtttatttagggcctatttgggtactgatgttggtgatgggaatacgatgataaaggagcattcagagtctattgggaaaaaggacttgatgaacaattaaaatagaggatgctgaaagctgtttaaaaaatacatctaaaaatgccatggaactgtgatacacccctcccagggaacactactcagcagtgaagaggaatgaactgttgacacacacaacttggatagatctaagggaatactgctgagtgaaaaaaaaaaaaagccagtatcaaaaggatacctactgtatggttccatttatgtaacattctagaaataataaaactgtaaaaacgaggaacgcattagtggttgacaggtgtcaggaactgaggaagaagggaggtggctgtggccattaaggggtagcatgaaggagctttgtgacaatgagatatttctgcagcttgactgagctagtaattacatgaattcacacatgataaaattgcatagaactaaatacgcacacacacacacaaatgagcgcacataaagctagtgaaatctgaagaaggtttgtgaattgtacctatgtcaatttcatggttttgatactattctacagttacacatgctgctaccattggggaaactggatgaaaggtttaagggaaccccctcatgtaatttgtattacttcttgtgagtctgtaattgttttaaaataaaaagattttctttcacgtgccatggaagttcagggcagagagtgactgactacctgagaaccaaggagggatgctcaggggaggggatccggaactagatcttggagagaaaggaggagttgagaagataggcaagttagagagaaagttctcctgtgagagcaaacagtacctacaaaggcatggaggtgtggaagaacatgacatattccagcgactgtgagcatttctaggtgactgaaacaggagctaggtgtaaagaggaggtaggagaagatgattaggaacagcaggcaagcgtgctacactaaggggcatcatacttttaccaagggcaatcaggggatgggcacagaagagactggcagaaaagggacctattaaatatttaggaagccactctaagcacaaagaacccagaaggcagagcctttgatgagctgtggacatctctgtctgcagttaagagccaagagaggattagggatctgggtaatgattacattatgaagcataggctgagctctgtggtagccacttggtctcagcccacacaggctgatacacaggtcaccatgtcacaggcaggcagcgaggctatggttccacaatcacgcttgtctttacctctttcttctagcttgttaggagaccatgaaatgtgtgtttgggagggggcaagtaaaagatactcttctagaagccaagacaacaaagaaaatgtccctcagggatcgagaccgtgaactcccaataggtcaacagcattggacataaatggcatgggaggatttggaaagggacactgcatgtgatttctctgcccctggagtggtttcacagtcttttagaaaggcaggagacatcgcttgcccccaacagttagcagaggcagcagcactaggttaaagaaagagcaggaggtcaacagcacttactttctgatattctcttctggttggaaccagggtggctcttctcatcactttcctcgccaaaccagtaggacttggtgcaaggaaaataccagggcctgggaattccgtactggcctgaaagcaaagcacaggtatgagccaagctcagcatcatcccagtattctgagggtttcccagccaggtccatttcctccttgacacatcctttggagaaggaacagatttgaatggatgtggggaaagagggagctaacatttgctgaaacctgctatgtacaacgtacattctgcacctctgtaagtccttccaacaacccacggggcaggtgccatccccattttagagatgaggaaactgagggataaggagcctatccaaggtccctcagccagtaagttaagactcagaatttaaatccagaatctgcatgctgcaaaattgcatattcaatgaaagaagttcaggcaggagtaataaatatttcatgtatacctccttaggggaggatcagaaggtgaaccaaaaagggttaaatcttgctctctcagaatttgatctcatatgaaaactgtccaacgcaggttcctcttggacttggtcaagaagatgtattatattaagaaagaagtactaaagaaaaattcaacatgaatttttattgaatgctaattaaatcacaggcaggccttagagctagtatatttaattattaacaacctgtactcaggaaacagaacctctcctagttgtaccccctctgaggacacagaaatacagaattgggtgagcattgggaggattcgcctgggcttattgacccagtgtaaccgaagtggattcacctccacgtaccaacatttaacagttgtgtgaccaaagctggttacttaacgtctttgagtcacagttctctcatttgaaaattgctggttattatagtaactacttcagagtagccttgtgagaattaaatgaagcaatgtgtataaaacattttgcatgctgcctggcacacagttttcaagaaacaagtgctgtacaagtagtgacaattgtactttcagcatcagctgcctgtccttggactatctgtttactatagatctatagcccaaaccacttcccagggaagcccatgcactgcagagattctagcacaaagaaaggacatcagctagaagtcatattttccaaacagatgcccaaagcagtgtacctggaaagacagcctcaatgtaccaggtcatcaccccatagaggaaggtgtcaaacagcatcatggagaccgaagtggtgagattgaagccatcttcctccacaggactctcaaacaggttgtcccactgcactccaatgccctgctcctcaaaaagggcaaagtactcacagccaaacccaaaagccacaggagacagcaggctctgtgagaaacaggcaaagtcacctatccatttcctggtcagtctcatttttctatctcttctagtgtaaattatacctggagaaatttgaatttgcaaaatggatcaatcataaggtgcagaagtagtatttacctatagagtccctttaggggagtggtgggctaccaagtaacatataaaatgattccatttgtaaccactcattatatacaaacatttcagaaatgcatatacagtgaagcataaaacttttaaaactttatgtttccaaagatgccccaaggctcagcaatcctgttcccccacacacatgcgcatacccacagtcttctgaggctccctgctcagccaaggatggctcaggatcagaggtgcctgtttggggctgctgatgcctatgaagcccagactgaggcaacaggagcatcctatgagtcactcttagctttcctgataagtgacctggggacatctgacaacttgcacttgtaggggctcacacactctccaagatatccccctgctctgtacgagggaaggaagtgtccaagtcaggaatttgtgggatgaggcacctgctcctcagttgtgcttagttcagaaaacattactcaagcaaaacaccatactggacacaaggaagacaagagaggtcatctctgacatcaagagttttcagttctatttgtggccttggctttgtcatgagcttaacatagccaacagagctgggagataaagggcagagatggcatctgttgcctgaagccattcctcaatgccatttatccccagcccagttcaagatgcagtctggctctcggaaaaattccattcaattcaattcaaccaggattcactgagaagactaaaggtaaacaatttaataaaacacaatgcttgcccttacccttaaagagcttagaatctagagctaaggttcatgtcccattggaaaagacaatcatcttctgttctcaacttgctgcttttattcagggactccaaaggaaggtcaaatgcctacagccactgaagaaaggccagaggtactcacagcgaagatcttgagtgtgaagcccacgtagtcctgccatgccacacacaggacgtagggcaggtacagcgtgaagtagatgatgcccccacaggctgctgccaggttggctctggagaagagtgtgctaatcaggaagcactgcaggattgtcaccacagcaaacacggacaggaagacaaacaccacgctgggatcactgtagggcagcaggtttcctaactgggaaggaagagacacatcaaatgtgctgcctcaacaatcccaagcactcacttgtatgatctacagaaaaaagacagggtttattcctactcatgttagagacaatgcagaggcgtaatgctgttcatctttctgatgaggcaactgatcattaccatcctaaagaagataagtgacttacccaaaactacgcagaaaaataatggcagagttatgaatacaacagagtccagggctttctacgcatttcagtgggcgagtttgctctttgtttcttcaataggtaatttcaactggtttctccttatataaggactatgactggtggcaccacagaagagctgtgggagataatatcccacgtaacttttctgtctaaaagccaaggaaaatggccaggcaacttgactttccctcttgatcaccatggattctgcattcccacaatcatccaaactcttgtggatattttgagcctatctccggctgatgggtacatgtctgcaggacccaccagcatgcagttgtctcagagcagctcttatgcaccaaccatgggaccactacctctgccactgaccttccccttgcagttagataacagagcatgagggaggggttgcttttagcaagaactgtatcctactgtggaacctcaataaagtccttgaccttcctgagcctcatttccttgtctgttaaaagggttagtgaggatagaagaagaagcccatgtgatgtgtttaaacagtccttggcaatcagtaggaactatttgtaacagatggtaactagtattaaattagttagttcttatctctttgtactccttttgcttcaaaaacatttatttttacctgatgtgtctttatatgaaatgcttgcagagaaagaaaattcggatataaatatattaatgtatggttcagacacaaaactgcactgcccagagtccccattcagggaagccttgttgcccagctgtcagtagacggcctcaggcatcagcaactctgggtttgtcacagcagcagagagccatgtaggccctggggcacgaccttcccagggcagcccacatccagtgattgattgagagggctgaggtaggtggtgtcaggagggaggccttgggggagcacaaagggctggatgtttcagctcgatgaagaacaactccaacaagctgcatattctctagagtgccccacggggttggccctatatcacagttcaactcctccctctgcccaatcctgcatcttccatatctcttccataggtattgagccctcataaatacccatacatcaaactctatttcagcctctgcttccagacagtctaacctgcaacaatatatatccttctgattattgttcttagaaacttaggaagaatcgccacccaatatatctaagaaaataaatagctttcagatgctgccatgaaccactaccaatgagacagcatggcacagttgagcatgtggttatctggaaagcatgaaccctgcactctcatcctacttagctgctacccggctgggttgaccttgggcaagtcactgcccctctctgggcctcactttccccaactataaatggatgaaattgcaggaaatgacaggtatgaccccttctctaccagaggcttggattttttttcttcttctcctcccttagcccgtgttgagctatttcggagtttcctggcagggaagagcgagtgaggctgccttaccttcaggatgaccactagcaggccagcgctcacaagaagaggaatgaggctactaatgaaccagctaaaccagaggatgctgttgtccaggcccatgatccgcatggtctctttcagccgtgcctccttctcatacacgatgcccttgatgatcacagccactgagtaaatccaggccagcgtcatgaagaggggcattgaccggctcatcacccgcagaaagctggaggccccaaggaaggacaaggggagaaagaaagacacacgtgagccagggtgatgggccaaggcctctgagcctgcatgctagagggagcaccacatctgggccacagaaggacaggccctctagactctgaaatgtacgtatgatccaatgcttcacgagcaatgcaatgtagagagaaaaacgaggctaacaaagtgttgccaaaccaaatttctttgggggcttgcttcagtaactaggtaactgtgagcgatacttaaactaaaggtagattatgttaaagtactaaaaaccaaaacaaaaaaacaactcattctctcacaaaagttcaacatctccaaggtcatctcactattgacttgcttatcgtaactctaatcacaccacagacatacatttcaggcagctcttgtcaatgtttcagattccaagctagaatagaaaatgcagatgtgcaaagtaaaaaggcacacagattttggaccctgaacttgaggttcacgtcaaagctttaccatgtaggcacatactcactacatgacaacaggcaccagctcttaatgcctctgaactcctgtgccctgtcttaagacatcctttctagagtaaaccttagcttaggggtctttgtaaaagtcttcctttgaaaaattccagctaattgtttagaaggtgaaaaacaggataatttctggtgaccttgaaaagctatagatagccatacaaggaaacacactattcaatgcaaaacagagaaccaatacaagcagaacccagctcctcccgcatcctgatccctacacacacacacacacacacacacacacacacacacacatcccaccaccaccaccaaccacagagaataagagaatttccagaatctggaagaaacattacatatttcagatgtctgcaataactacacctccgcccattgtcttagaagaaatcattacatccaaaggcatagttcccacaatgagaacttggcagcttagtgactcagcactgaaagattttctaaaaagtctaagaggaagaagctttgttcagttttatttgggttgttttgaaatgtggtttaccacctagggagaagaagtgcacacatttacataaactgtgcttttataagtttagacgctgtttctgcatctatgtgtgagtatgtgcttgcatgtgtttgtcatgacacattttaagcttgcagattgagcaaattttgaccaaaagggtagagtgtaaaaaattaaagtggtgggctgggtgcagtggctcacacctgtaatcccagcactttgggaggccaaggagggtggattgcctgagctcaggagttgaagtctagcctgggtaacatggtgaaacctcgtctctactaaaatacaaaaagtcagccgggcgtggcagcatgagcctgtagtcccagctactgtggaggctgaggcaggagaatagcttgaacccgggaggcaaaggttgcagtgagccgagatcgagccactgcactccagcctgggcgtcagagcgagactccatctcaaaaaaaaaaataaaaataaaaagataaaagtggcaaccatggatgagaaggaaagaggtttactagtgtgtgcacatatatctatgtctgtcatgtggctgcaactgttgacaacttacatctggcatcttatttccagatcattcacacatgcatgcacatgcacacacatatatacacccccatctggcacagtataaactggttaaaaacagtggcttgcaggtaacttacatgtcatcaacgtaacagggatagggcatctgttgcatatagacaccagttttcttctcggtgcccgtcagcaccctgatgattgcctgctccaccacatcctgcaagtaggcgaagcccccccagacgtaccgcatgtcctcaaaggggtcagctcgaggaccagggtcccagtacctaaaaccaaaccacaggtaatcaaccattcctttagaaccatacaataaaaaaaaaaaaaaaaaaaaattgcccaaaaccctactacccttaccaagcccctttttctatttttgtatctttttttttttttgagatggagtttcactcttattgcccaggcgggagtgcaatgatgcgatcttagctcactgcaacctctgcctcctgggttcaagcaattctcctgcctcagcctcccgagtagctgggattacaggtgcctgccaccaaaattcctggaattaattcccttgagtagaaatgctaaatcaaaagatactgttattttatgacctatgaaaaaccttccagcaagtcatgtaccaatttcaccaaaatcatgacaccaagttgagtttttttgttgttgttgaaatttctaccaaatttttagttaaaataaagtacctcttgtcctaatataataggtgctctggacctccccaagaccaggctggtgtgatgggattccacttacccatccttgattttatttgtcctctccacattgtcaatgtccattcggatcttgtacttgacatgatggggcagctcaatgctgcctggagtaattccagtgaacacaataccagcccagaacttcctctcatccagcagctccatggacttgttgatgagccagacttctgttgctatgggttctagcttgttcaggttgacacactgatagaagaacagccttcatgagaacgttggcagccaggacaacaagcagtggctgagacaaatcctacactaggaggcaagggctgactacacgattgctcatcctctctctctaatcctctctaacgtagttttccaaccttcaaccaagaatgaaggattttggtttttcactgcaatttaagagaaattctaagagtaatttagggatatgttatttattgattttgtggaggaaaagaggttaaaacaatgatcttatcttacttttctgttttcttagcaattctgagtcatagcaactaaccaaccaaccagaccaaaacacctcttacccatccctactaatataatttttaatataaaatttcaaaaatttaattggacccgaattcgattttagataagtttcacaaataatgcctttttaagggaatgctttgctaccattagtcactgagataggaaaacctagaagaaaatgggtagaaatattctcttgagcctatatagaataagctagagttaatttactaaagctagagtttatttactcattcaaccactcaactaacatttattaagtgccttttgttatcaaatcctgtgttaggcttgagggatagttttgtaaatgagactatacattatttctaaacttgcctcctgcctgaaccttattgtaacgtctcagagaaagaagccgttaagtcttttctaaatgatcccagcaacagattcacctccatgaagcgagatatggtccggattgcctggttagtctcgttgaaagcttctctccaggtgtacacagaaccattactggactggacatcctctgggtgcttggccaaaaacgccacgatgtcttgggctgtccaatctaagccatccaactgctgttcccaaaagtggtcattgtccctgctgtccaacagcatctgccattccagtgagaaagtacaagtagtaaacaccaactaaatcttgaggagcactacaaaatttacaaaatacttgcatatacactgtcgttgttttatcctcacagaaaactgaggtaaatgacagtgtccctattttatatgtgagaagactgaggctgaagaaaaaaaaacatgattttaaccagggcttggtcatagtattactagatgtggagctgagactcaaagtcagaccagtctgaattcagagtccatgtgctttccactatacgaaacatctcacttaatggtattaactacagtaacaacaacaatacttcctttatatagttactatgttgaatagtgtatatgcttcaccttacacaactccataaagagggcacttttatttttttgccttttgttgttgttgtcgtttggattcagtgtctcgctctgccgcccgggctggagtgcagtgatggaatcacagctcaccgcagccttgacctcccaagcccaagtgatcctcccatctcagcctaccaagtagctaagactacaggtgcacaccaccacacctggctaatttttaattttttcatagagacagagtcttgccatgttgcctgggctggtcttgaacacctgggctcaagtgatcctcccacctcaacctccccaagtgctgggattacaggcacaagccaccagcccagtgagtatcctttaatatttcccattttatacatgagaaaatggaagttcagagaggttaagtctctaagattgggtcacacagctattaagtagcaaagccagaatgaaagcataggccctctgtttctagtgcacctccccctccccactgtgttctatcaccttcctcttttgagacccagtctgttgatcccacataaaacctaattccttcttactgcttagtttagaaaaataatgctgctggttaaaccaactaaagtacaatcttttccaattgcaggatgtacaggtcatgatgcaaaggaggcctatttccatttcttgttcccttgccagttggttcctcacatgggtcaacacgaaagagaaggacagatcaatccgctgctcaatcagcagatccagaggggccgaggcagaggcctgcacagatgtgctgccggaaaaacagcagctgcaaactcagcaaaaaggagaggcatttgcaactcctgtcacagcttcgacagagaagatgaagctctggttctaccgaattggagtctccaagggtctgaaaactgctgctttataaaaaaatcagtcttagtttcactaacattataagcttttccccccttgcgcctttgtatttattatttcaatggcagcataatgattgtatagagtatatgtaatttcattaattattcctatagtgctgaacatttagtctatttccaatttctcacaataacaatatagcaataacattttctctcatatggtgacttctttaaaattatttcagtaggctacatccctgggggtgggtggaatggaggtacgcaggatagcatattttaaaatggttctttaaattttcattccaaattgctttccaatagagaatagcaatttataccatcaccaggaaggtatgtatgtatttttgttaacataacagacacaaaattgtacctcacaagttcacagaggctagggttagcaattctgaagccactttatttggaacaaacaaaagcagagtgaagagacgcagcctttagggtgaagtcggccctgcccagtatggtttctgaacaacatggccaaaaagaatagcaagactagaaagatgcgcccactgagatcactgagcacgtggcctctctggggtgctcgtgaggggcaggagacctaagactgcccgcaggggtggaggcagagagaaaacaggtcccgaggatgggtggctaaaagcagctcagaaaagagagcaaatcagtgtcagagggttccaagacttgcccgagagaggtgccctgggacctgtggggtgaggcaacatgggtagacagtgccagagaaagcagaaagatcagagctaccccagcagaagcagaagcctcagccatcacctcgtgtaggagatgccaggctacagggggtgacaagctcatgtttgtggaattaaataaacactctttaagagagggaagaaaggccgggcgcggtggctcatgcctgtaatcccaacactttgggaggctgaggcaggtggatcacttgaggtcaggagttcattccagcccgaccaacatggtgaaatcccatctccactgaaaatacaaaaattagccgggcacagtgatatgtgcctgtaatcccagctactctggaggctgagacaggagaattgcttgaacccaggaggcggaggctgtggtgagccaagatcatgccactgcatttcagcctgggtgacagagcaagactctgtccaaaaaaaaaaaaaaagagaaagagagggaagaagcaaagaaaacagttggaagaggttcccttttcttccacccacaggctgatgactccctcatcatctgtctccagcccaaccaccctcctccactgcagacctcagtagccactggcctactggacatcgctaccacccacccagctagaaatcgagactcactttgatgcctccctctctttcactgctctgccactaagcagtcaccaggcctcatttcttgctttatgccttggccacttggagagcctcctccctggtctctgccttcattcttgcctcatccttcttcaattcatccaccccatcagagtaacgtatctacatctccccttgcctggtcccctagagcttaaagtaaaggtcctcagcttgacacacaagtccctccaaggcatgcccatgcctttctctccagccccagatccctcatttccaagcatacacactggattttcccagctagattcctaatgaatgccattgccatgtttacaaggatcttgtcctttaagaactgggagcttatgaagaattgaagcacctaaggcaaagtcaatttcagactagggaaccatctacttgcccacaaatcaaaattcactgagtcacttcacagggcctcctataatcctctgagagccagacaaacagaaaaagtccaactagtagaaatatggattccaaggagaggaccaggaagaacaggtctgaaaccacacttaggtctacggggctagatcatataaccctcctttagagaagagaccccactttaatggcatgagctatattagtcagtgtgaatccatacaaatcactgtttatgcttttctcagtataaactcctttgtttttaaagggacttcctcagtaacctgcctcccagcggatcagggaatagtcctaaacttcggaagtgttccccctaggtaggtacagtctctaaaacccagccgcccttaaagtcaataaggttcaaaacaagaaacctggcaaaatcctcacctgcttcttaaggggagcagagacaaaaggaagaggcctccctcaccatggaaacaggaaatagtctaatgattctctaactcagcccaaggcaggaagatgtgattaacagcactcaggctcaggcaaaggagacattctgttcttgctcagcctgctccacatttgaacccaattgtctctagagcacttatccctttcaagtggctctgaagcactaagtgcatttcccctccacacagtaacagcagctcatcattcacacagtgccctgagaatgagtatctcaggccagtctacatgtaacatcatgcttttgctcccacacttctttccaaaacctaccaagacacagggagatgctgtggctggctgagaggctgcagccaaaaaggaaaatagggtactgcaattactcaactccacttccaaacaccagccctcactaagttttgcagaaaactgctatttgaccgtgagtggcatggatgctgatatgcacagcgttatctctgcaccatggcctgtacttctggagaggtggtgccctgtgactttagctatgctcactacattcccccagctagataaactgaaagaattctcacctcactcacacctgggaaagtgaccagaaactcacctctccagtatcaagcaggcacatggtaataatgggagggacactcacccggacaaggtccatttcttggctgttctccatgaaggtccagatcttggggctgagttcctcccacatgccttccagatcatggaacacagccagttcctggaaggtcttgttcacctggagtcaggtggggagccagggaccgcagaaaaaggaggagaagcacagacaatgagcgtttggctcctccctgaaaagataccccatcacagcagccctgtgccagtcctccccatccccaagaaatgcctgcttgtaactatgattctatacccacgactggggagctggcccagctctggtctgcatcagacttgaggttttcactctgggaattccagaagagccgtgagtatacttagcgcacacctctgaagctaccttgagttttttgcccccagttctggggagattctggggagggagtcttgggctgggggcagcttacctcagccatgacctgccttgtggctggagtgtcaggtgtatacaggatcttcccaacgagcagcggcttcagagctttccagataatgcgggaaagaggactagactccaaattcttcatcaaatcattgcagtaaggagctatgaagaagaggagagacaaatgctcatatgcatggtcatatactgatagaaacttacaagggctttggagccagagagttcttagttgaaaccccagctctaccactactagtcatataataagtaacttatctgagcctcagttggctcctctgtaaaagtaaaattcataacatctatgtggagagatgtggagaagattatctcagattaaactgagatatctataaagaatgatgcttgataaataatcagagcttattataacgtcaatgacggataactcacgactgagctgatctggaaaaatgttttcatgaagcacaagccctcccatccagattcacactctcatgccagcctcaccattgttttcactgacaactaacatgaccaacatttaaactgactcttgaggggcaaccagaaggctgaattcagacctcagttttcaagcaaaaaccaaaatttggggctgggcgcagtggctcatgcctgcaatcccagcactttgggaggccaaggcgggcgaaccacctgaggttgggagttcgagaccagcctgaccaacatggagaaaccctgtctctactaaaaatacaaaattagctgggcgtggtgacgcatgaggctgaggcaggagaatcgcttgaacccaggaggcagaggttgcagtgagccgagattgtgtcactgcactctagcccgggcaacaagagcgaaactctgtctcccaaaaaaaaaaaaaaaaattctcaacagggcgcagtggttcacgcctgtaatcccagcactttgggaggccgagacaggcggatcacgaggtcaggagatcgagaccatcctggctaacacagtgaaaccccgtctctactcaaaatacaaaaaaaaaaaaaattagctgggcatggtggcgggcacctgcagttccagctactcaggaggctgaggcaggagaatggcgtgaacccgggaggcggagcttgcagtgagccgagatggcgccactgcactccagcctgggcaacggagcgagactccctctcaaaaaaaaaaaaaaaaattctctttaattaacacaaactagtatatgtacacttaacaaaaacccaaatacaaaagttgtaacagacaaatgggtttggttatccagcaggatccctgatttttaaaaattcattctaagtttttcagggatttttagataccaagtatcttctatatgctggaaagataatagaatttttttttttttaatgaggatgccctcacaattaagtctgtcatggaaatgaaggcttccttgggtcaacttgcaagctgggggagaggaggagatgggatttaattaaagttgcctacaataccatccttttaaggcttgtaaagcaacttgcgaatgtctggagtgctttactccagagaagaaaaggttcttgtgttacaataaagtacaaaacctgcctcactcagtgtctgaaagacacacctgtggttggaaatggagaaaggttcccctgcatcaagttttcaaggaaaaggatgccactgcctaaaactgtgacattggatccctgctgccacgaggcatacggcacacgggcccacaaaagtgcttaagtgtggggagtggatatggagacacagggttctttaacactgccttgcagctaagaatgggaaacaaagggcagatcaaatgtctgagtgtgagaacacacacgccaccactaacagttatcttagagagcacagatccaggcagatttgggcttgaatcctggctcttgtggattaactctgatgtggctctaaccaaggcacttaacctctctgagcctatgaaatgtggggttaaagaatcttccctgcagggttatcatgagggtaaaatgagataacttaaacagaatgcacagtgcacaagaaattctacttaaatgttagttctttgttgttgttgttgttgctattatcattactgttatttctttttatgttattataaagcttatctcaatggtaatattaagaccagtacatcatcctttttaaaaatgcttttctagcttttttgagttacaactgacaaataaaaattgtatatatttaaggtatacaatgtgatgttttaatatatgtatactttgtaaaaggatcaccacaatcaagctgttaataaatccatcacctcatagttgccttttttgtgtagtgtgaacacttcggatctactctcttagcaaatttcaagtatactatacagtgttactaactatagtcatcacgatgtacatcaagatcccaggaacttattcatcatgtgaaactgacactttctaccttacatatattccatatataagtgagatcttgcaggatttgtccttctgccattatctcattcttgatcaccctggaagccacccttccacatcccccagaaaaccagaaggttggctgtcaatcattcattccattgataaacactactgtgcacctgagatgtgccaggctgcattcagagaactggggacaggtagctattcaagagaagcctctctcctctaggaagagctcagtctggtgggcaaatgggcatgtagacatctaacgctgctacagagggaggagatgacacaggccaaggccagaactaagggagggatggggttggggacagggctggggtctgcatggacactcacttgtagagttgtcatagaaggtttcagcatcttcctcagtgccattgcctccaaagagggctttgtagttgttgtcctcataccagttgagagacttgatcttcagcccccctccctcgggatgcccgcagacaatacgagacacagcctggtagatttgggtggaggagctggagctgttcacattggtcagaaacatcacctcctgtcgcatgtcactccagcttctcatgctgaacagctggcgtcagggatggggacagaaaggagggtaggggaagggagaaaagggcagtgcaagggttggggatgagaagagaaagaaacatcttattttcttgacctctcaaaagccatgtcccagaacatattttgtctgatgtcatctcaaagccttgggatgagcttgccagaacctggctacccaatctgtggtccagggacgagcagcatcagcattactggagacattgttggaaatgcggattctgagacccctctgccgacctgcagaattcaaatctacagcttcacaagatgcccaggtgattcctatgctcactaaagtttgagaagcacagcctggagttagtgaagcccctggggctgggcttcgtttcaccgggattatcttccagtttatagataaaagaatgctttctctgaacagctacatctcattgtggttgagcctatcaggaactgctctcatcctcgataactgactcatttctaaaactccccgaactctagtgtagaaattgaacagccctcttccgccttgggagaaaaggtactgtatgtgaagttccctatcttggtctcagtaaagtgtcaggcaatgaaaaagcattaagatgaaaaactcgagtctgggccgggtgcagtggctcacacctgtaatcccagtactttgggaggtcgaggcgggtggatcacctgaggtcaggagttcaagaccagcctggccaacatggtgaaaccccatctctactaaaaaaatacaaaaatgttggccaggcatggtggcaggtgcctgtaatcccagctactggggaggctgaggcaggagaattgcttgaacccgggaggcagaggttgcagtgagccaagcaccactgcaatccagcctgggcgacaaaagcaagactcagtcttaaaaaaaaaagaaaaagaaaaagaaaaagaaaaactcaagtctgaaccctagctatgtccctcgtcagcttacagcctttgaaaagtcacgtcatgtctctgagtactcaacttctccatgcttcacggagctcgctgagacacaacttggcttggttttggtaaccctggggggcagtagatgcttataccatggcctggacactgccctctactcatcatcaagacagcaaagctacaacagtgtgtggtgaggcacaaatcctatgccacacaagagggtgccctgcatagaacagtcccaacagcgtgagtcagaaaccctaggcagtgtctgtgactgccactcaacaggcatcaatgacccaggcagcgttctgtcttacatgcaaatgtattccggcactttgtggagttctcagccccaatgctattatgaaatatttatagagtactttgtatttccaaacatttcacaagaaatcattaataaatccctgtattcctggaaatgtcactgcgtgttcacaccgcctgggaagactgagctatagagcacagaggggaggggaagggccacgaggccctgcacccagcctggaaagctccatatgcctagctttcaacctcacagcctgctggttcctgtgagtggcgtggtccagcactctctaggtcctaagctttgccttctgcctccagaagggaactaggctctccagaggtgggtcagaggccacaaggattttttttctccagagagggggcatctagcacactccacaagaacacaattaggtgaggtggacagcttttcccaactttttcttttcataacctgtacgaggcatacagacagaaaggggacagagaaccaggccattttgccttttgttgcttattggaacagccctagagatttttaaataacagtgagtcaaaacactcacttctctttccacaggcagcctcaccaccaacccaccactccccaatcaaaaaaaaaaatttcttcccacataaagccagcaaatctttctaaagaagcaccataaattattgagttattccaaactattgactcttcccagcacccgtttcaggggtaaactcttactctttctcctacacctcagctcacactccaaactttatctgggaagtgcttcctgactctcagggagggatggctcttcatcctttagcccacggatgatggtggtatttgaacatcatcggttgagtgaatgaatgaaactgacttactgctttctcaatccagcacaatgtcctttgtcctccctttcccccatcccagtctcttctcaacccaacaaccagagtgtaaacagtctaaactctagatcacatcatgtcccctccctcaagccctccgctggattctcatctcacccagcaggaatccaaagtcttgccaggcctgtatggcactcacctcctcctgctctgagctcctctcctccccccaccacttgctcactttccctggtccttaaacacattccttaggcatgctctagcatcaatgtctttgtatctgccattcttcctgttcggagtttccttccctcaccacagacatgctatcatctccttcaggtccaactgtcaccttagagagagctttcctaatcaccccctttaaaaaaagcaccttctcatgctctatgccccttaccctgctttttcttcactgcatatatccctcctgtggcattgtacactgacctgtttgtttctgtctctcaccctatacgtgccccaagaaagcagagaagttagcgtgttcactgctgagtcctcaacacctagcaatgccaggcagctggtcggtgctgggtggacatctgagatgctgcctccctgtcctcccttcccatcacccagatgtgaaactcaggtcagctttcattcatcttattcctcaagtcctcatttcctcccaatttccaggttctgctagtgcgtattttctttcttggaaggttctcctttctattccagtcgctactggagtttttcacgaagcaggcaacaacacaggctttggaatccaacagttctgggtttgaatcccagttttgtcaattaactcattgggtgactggaaaagttgcctaacctttctgagccttggtgccatctgcaaaatggacatgatgagacccactcaggtttgtcatgtggagcatacagggaaatgggtgacactgtctgaacctaggcagcttctcagaagacattcactccctttttcttttcctttcaagggttgtgctttggtcaaaattatcaactttccacacgctgactggacaaacaagtgcatttattgatcttctcccatttatctcacagaaatagcaagtcagacaatgagtaacttttgatcaaagggatctggaggtgttctattgaaagaggcagatggtccttgcttgtcctggaccaggagcaagcagggcacaagaaacagctgccaagaaaaacgtatattgttcacttggagagtttccaccacatcagcaatgggaacatcacctgcttccaatttttttttttaatgccagaaaaaaaaaaaaaaccagggccagtgatgtaagtgaaaacagctgtaaccaaaccctgagtttagaggcagcctcccctgttacagaccctgctttgctttctctaaggccagaaatgaacaagggacagagggctgcgaggggatctgcagagcaatgcaaggcatgtcaatgtcagctaacagggccctagagaaatagctacggacttgcaaaacagtttctctttctcattctccccctggaagaaccccagttggtccagcttctctacctagtaaaaaaggttaccagccttcataaccagggtaacaaatggcaagctgaaagaaggcttctcctctggaaaaggaacccaaaagtcagacctcatcagtcagaaacacgtgagcagaattcaaagaaagaaagtagaacaggacaggaagaaatacactaacgtatcaatagtgtttgatctcagcatttttgtattttccaagtcttcagcattttccacaatgaacatgcaatactttcattgttagaaaacataaagttcgtttttgatatttgaaaaaatgatgcaagcaccaaaaaatgggtaggttagatacaagcaccaaaaaaagaaaaacggattagagaagcagctaaaaataagggtggaccaagtctgagacaatttccccacaaattattattttccaatatcctacacgttaaagtctgtattgtttgtgagcactgccccctggctcagcttcctatgctgggggacaccagacagttcctcgcttccaagcctaatttgagacaaggctgggagtcagaaaggtggagtgtgcactggctgggagtcagagctaactgcttttgcaagtgcctacaggccctctgatcctaggacagagattactctgatacatttgtcaacatgtggacctaaaaggcaaactcaacttaatgttcattaagagaccatattcccatagttgaacctcagaagccagatgctttcaagggaaagggctgaattaggggtaccacgttattcctgttagttagcaagcatgtgtgttggtaaaatgattggccttgctactgaagaagcaatatggagaaattgctggtcagacaaaagcagtgcatgggcagtggcagagataattctcctctttacaaatgtatgattacctaggggcaaaaagaaaaaatggagaaggttctaaactagatatccagctgttagccactaaccaattagctctgagacatctatgagttttaggtttcttcatttctaaaataaggaaatcaaaacattattgtttacatcacttatactttgaaaattgatattacatcccatgtgatattcaactcaaaaggacctcttgccagactcaggaatgaaaatactgatacagtggatgatccgcttcctggtactggaaagacacaacttacctcctgggccagagtcccaagactatgcagcaatgtttttgtggcttcagccagctccttgctcgggaagggagatgtagagtttagtgttctctgtaatgagaaagaaaactttgtttctgaattcaaatgtaaacctgaaatctctattggaaataaacaagtgaattaaaactgttcacaatcttgagtttaacaaacaagaaaccgactcctaaccaaaactaaagacactacaattatttctaactgtaagtttgcattttgttcattttcaaactcattctttgattaatggttttaaatgaagtaggaatattgtacttaaaactagttaatatgcaatagattaaaaggatctcatgtgggctggggggatgtgtccaatacaactctgaccgcaaattcccaaatctgtctgcgtctgcaagatgggtaatacgggaatggctttgagaaacaagttaatgacggctcacaagaaaggaagaaaatataaagtttaaagctgtcaaaaatagggaaagatggaattctgtcactctgttcaagtcagcactgtttctaacactggaaattgaatgtagaacacttatttttacatcgagttttagtcaaatctttatatgtaccaattcatatatttaattgctgttatatgtcacctaactgcacagcagatataggacaataattcattagaacagggaaaagataaattagggcagaaagcataagctaaagaaaaaaaagaacaataatttacagactgtgaagtcagaattgctatagctgaggagcctcaagttgggttctgagtgttcaggcttccaaagagaaaaagacgtgagatcagtttcttcactgttatttgtcaagcaggaaaaaagtatccagggaaaatccacctttcttgatgtttctatgagcattgttttattcaatatcatatcagacatctctgaagtttagagaaggttgggctattttgacatttgtcatatcagagactgctgtgaaattataatgtagactacacaagaaaatgtctagaagtggctgggactcactatctctgagaaatagctgcctgggatgttttctttcaaagagaattccaaatgcagaagggattgagtatcattctgatcatcacaatatccaagcataatcctcaatgtgcatttctaagaaaacctgcctaaaggttctatgaaagaacttgtccagctcattcatctcttctggaacgggttcttcaccagagtcccaggactcccacattcacagtcctcaaagggacctacgcggtctcccttaaacgtcagactcagataggcctctgtgatacgcagaggtgttcatgattgttccttccatagagagtaattcatgagcaaaaacaggtgaggtgttttgtttctactttctctctttgggttcactttataactaaaggttaacacactagaagccgaacctagggagaacttgcctggaaaactattacaaacacaaactgagagatcttaattgaaagctataggaggtaaagtgtttttgtgtttaccgttaggcctacaagatgacagatgttcaagacagcatagcaaaaacaaaacaaacccaggacaaaacaagaaacgccagatccacataacctaaatttaagaaaaacttaaaaacgtggtagttaatccacttcttttataaggactcaatggaaataagattgttaggattcttgtcactcactctcccccgccaccctgtgccccaattctccagtcatgggaacctggggtagctatagaaccctgggcaaatgactcaaattccccatccttccattttctcgactatgcagcaaagtttaaaatgctgtgcacatatcacagagtttttataagcactaaaactagaggatatgtacaaagcccctcgcacagtgcctggcacatggtaattcctcacaattgtcaacaatgtcatcccctgcctttttcttcccttgcatgaaagtttactgccaaaactggagggcttttgtctgcaaacagggttttcaacttcttaaaaagacaaacatcctttctctgtttctcggcaaggtcttaaactttttcttctattgaaatgtccttcctctgctaggcagagagctagagctatcatcacacagcatatcagccacactccaatgtgctgtctctaattgtataattactccccaccacaaggtgaagacatcctcatcctgattcctgaaggcttgggataaaatgcctttctccccttctaacccttttcttttactgagcatttgccaaacggcaaaataaaagataatactaagtggatgaaatatacatgatatgcataataggttgtgtatagatatactatatgcatccatgtatgtttttacgtatatgtctatatgtatagacatacatacacacatatatcttacacatattaactggcctcaaagttgacatttcagttgaaaaacctgaaggaaaactcaatccctatggtaggtatgtgtatacttatatgtgcacacacacacacatatacatctttatcttaatgtatattcattatgtaccttctctttaaagcaggtgatgtttttacagcagtggtatagcttcccttgtaattaaatttaattatccaaaagaagtgacttaatttaaaaaatatattaactaaaaatgctaccagctgcacttgaatatgaccaaaatcatggcagaattgtaaatgactgggattcactaacactgtgaggtttggggagctactgtatcagaatcacctgtggtgcttgttaaatatgcagattcaggctgggcatggtggctcacacctgtaatctcaacactttgggaagccaaagtgggtggatcacctgaggtcaggagttcaagacgagcctggccaacacggcgaaaccccctctctactaaaagtacaaaaattagccaggcatggtggcatgtgcttgtaatcccagctactagagaggctgaggcaggaaaattgcttgaacctgggaggcagaggttgcagtgagccaagatggcgccaatacactccagcctgggcatcagagtgagactcggtctcagaaaaaaaaaaaaaaatgcagattctcaaccagctaacacctactgaatgagaagtttaagagtgtgatccaggaatcctcaggagactcttttgagcactgaggtttgagaaccagcaccatgttcacaaagcctcccttcccagtatgctttgcgccaacgtgcttggtggtatattctgtgtctggtccgcatactacaatctgcttcagactctgaagcagtgaagaggccactcggttcacctggccctgagtaggacccaagatggtgccaaacacatggggtgccaggtttgtcacaccaattagatacagtagtcaccaagtgcagatgtttctaaaaaccccaaacccaacattcacccattgtcaccattaccggtcatctgtctcctgaagggtacaaatcagtgaatgggtctgttgtttgtataaaaggtcttctccaacttaatgaatttacatcttcaagggcaatagtttttccaacatctttaggacttttagtttaaatttcttaactctggagcaagcttattctccttctcttaaaagccccacacttcagcaaaactccaggcacacagcagggcctaaagcatgactgtttaacccaggaatgtaattgagcatggatgtaaacataggtccttattaagtttgctgtgggcatcagatttttacattagcagacacaaattcaatgccatatcttatgatatgaccttcttatcagtagtctgtatgttgggtttgactgcttgtttaatttgactgtttttggttttggtctccaacagaaacattggctgaacccacccatgagtaataaggtagaacagtcaatgccattgttagaatcatttttaaactagttctttattcgagattaagtgctcagcatttactaataatattggcaatctgtagtcaatataaacaaatttccattttcaaaggaatattggttggagttacacaatcaggcatggattgacatcacagggttaacaaaacacacatgattcaaattctacatcaagtttaaagcttggattatccagatattttgctcatgacttaattttacttttctgtgcatccaaaacataccataacctgaaaaaataagccaaagactagaagcatggatttttaaaagtttagtataaaaatagaatactatggcaaaaattaaccagattccacatgtatcaacattgataaatctcaagaacataattccaaatgaagtggcaggccaatatgcacacttatacaatgtgaacacatttaggccagtaccaaatattgttatacatagaatgtaagtatacatgatatagaggattaaaacatccaactgcaagacaagagttatctctgaagaatgagctagggaaacagaggtggcatcagctgtacctgtaatgttttatttcttaaatagaacctggagtcagcacggcaaaatgatggatgatggtacaggagtgttctttttgtttgtttgtttgtttgaagacggagtctcactctgtcacccaggctagagtgcagtggtgtgatctcagctcactgcaacctccccctcctgggttcaagcaattctcctgcctcagtctctcacgtagctgggattacaagtgcacgccaccatgcctggctaattcttgtattttcagtagaggcagtgtttcaccatgttggccaagctggtctccaactcctgacctccagtgatctggctgcctcagactcccaaagtgctgggattgcaggcgtgagccaccacacccagccaggagtgttctttatgttattctctgtaccttttttcatgttgaaactatttcataattttctttttaattcaatgaaaagataaaagaggaaggacaggtgagcaggaagaaaggaagggtaaagaatctatgttggcctgagcacatatcagatctaacagacagataacttccttgaataaaattaaccccaggaaagaattcatgccttgaaactagaacacaaaatacggtctgagaatcatgtgtctgcacctgctattaactgtgctctcctgctcatgcttacttgacgaaggcagacaaaacttgccaaatcctatttccaaagagcttcagtaaaaaattcacagcttggaattcctactattatttttctaaccaaaaacattctcttggctatgaactcacataggtctccattgcacccaggagacaagtgactttcttatacgaagtaaaggaaatgggaaaaagaaggaaaataaaacctttagtgagggactatattttctgagttaagataacaggaattcatgtatgactcaatattttcagatcataactgtaatgtcattacaggaagaatgcacaaatgcttactgttattattcaaaagctcccacccacttctgcaaaatgtgttaatcacaacataccatgtttcctaaaagcatggcattctgtgacattggccccagaaagataaaggctgttgtgccccattctttctgggtctaagagatggcttcattatattctttccatcctcatgaacttagttctgctccaaaggccattcacattcacagaaatgctctgtttcgtattcacctcatcaagtcactcagcctgtggagcctttaatggctccctttactctgaggataaggccctatatcctcacatggctcgtgaagaaagacctgcctcagccgacctttgcccacctctgcaggcatcacgtctcatcgttccttctcccatcaaactccccacagctatatctgctccatgctgaactatctcaatcaggtacagttcccctaaatgccaccttctcttccctctcctctctggaccaatgcatatactatgtcctctacctggaacattctactccctgttctttacctggctgacatccattctttaggtccccacttagaggatgtttccttcctgactggaaagactgcagtaggaggccccatcagggactgtatcacacccagcagagcgtctcctgctctatacggcagctgctcctttcctggtctgtcccacccattccccaaccaggaatgaaacagagagggctggaccttgcacatgactacctccctgggccagagcatggcactgattagggctcagtaaatgtttactaaatgaatgaatgcatttgttaatccattatcactacacgaaatgaacactggaagataatattacaatgcattaggagtcacagccaaatagaagtagaaaacacatctgtgcaattaaaatgcaactgaaaatattttcaacttataaaaatctcatctacatctaaatttttcaggaattctatgacaaaatgagacgtgggtatacatatattggaatagtattttcaacacaatacacaattttgttttcctcctgggaatgcatgttacaatgtgttcattgaaacatttcaaatgtcctttaaatatcttcataaagtagacaaaaatctctacttcactttgaccatatgcaaaatccaactcaggctgggattagtatgttttagttcaaactgaaaacaagtaaaccacaaatcaaagactatcaccacccaggagtaattgctatctctttctggtgatttctatgacagtaaagatttcctctgggaaacattttaatattttttattgaaatacgaaattataagactacatttctaaggaatattctaatcttttaaaaaataaatcaacaacctaaatattaactttcaaattagatgtgtttaacgcattcaaacgcttcattttttgctgtttctaaacatagttaaatacatctactaccacataattcagaggaaaaaattaaacctgtatcttagatctggcaacaatatttaatgaagaaatagtataactaaggtgaaaatgtctgtgtaaatggagttgagcagtcatattaacacactgctatatctaccagctagtgctcttcttttcccataagaatgaggtgaacatagagtctgaagagtaaatctacacagtgtgtcattccacccattaccaacccatggggattgcggctgcttgctgggagaaagcaagtaaacaggtgggcagtcaaatcacacaaagccaaacaaaatctgatactttccaacaatgtccgggttccagacaggagaacacgagcaagtgttctctcctgcaaaaacccacacagacgctttaaggactgcatgtaacaagctgaagtatctagccctaaaaagccatgaggctgaaggtaacaacaagccccatctgtattctgggtccttgtctaagagtcaagaagaagctaaataaagacccctcaagacaaggatgactttgttcactccttatccatctgcttcttcgatctgtacacagctcagctgtgacattacttgtcttctgggagcctcggggcaccctcactttcccttctttccctcatgaaccaagatccacttggtgggaatgtgctaggcacactggaagacacgtggacagtggaaccactggttccacaaaaaccacttcttttttttccccacgttattgagatggagataaatctgcatgcctggacttccaaccttaaggatcagacaccattttcacatcactgaggcaatggtgagtcaaggacagagcccaaacctagctcattcaaccccacattcctcccactacagcccacagtgtctgtgttggcaaagactgctgtgagggagctggtcgagaggtcatcagtgaaactggaacgaggacagctctcactctgtagacccaggacctacaaagaattcctcaaattcccagactcagccttcagcctggatctcaatgcccatcagaatgaaagctccaagtgcatcacaactgccttgttggtggtcgaacttcagtgcctagaacagtgctggtataaagcagacatacaataaacacttgatggatttttttcgatgaatgtctcatacctagttcagagatgttctcctcccaaagtcacctctgtttggtttgtacattaaaaaccctaataggtgatgcttattatgctttagagtcactttccaaatatgggcaagaaaaagcagagagctgcagaggggtcaacaaaagccaaaggcactgagggaacacttcaaatatatgataaactattccttccaatcaagaaagctacagcagactgaatatcccctgcaaagatgtccacaccctattcctggagtctgtgaatatgcacatttcatagcaaatgcactgtgtagatgtaattaaagttatgaacctcaaaataaggagattatcctggattatgtgaatgggcccaaactaaacacctgagcccttaaaagtaaagaactttctctgactggagacagatgtgacaggaggcgtcagaggtttaaagtgtgagagatactcaacccacttgtgggagaggagtcacatgaaaagcataagaaggaatgatggcaacctttaggagcaaaaaccagcccctgctgacagccagcaaggaaatggacttcagtcctacaactgcacgggactgaattcatctgatatcctggatgagctccaaagcagattcatcttcagagcccccccaaaaaaacacagccccacaaacaccttgatatcagccctgtgagcctctaagaagtagacctaggtgagctctactgtatcctggcttctggccttatgaaataataaatgtatgtggttataaactgctaagtatttggtgacttgttatagtagcaataaaaaaaaaaagtacaatcggaagcaaatcaatctctcgggccaaaatttgctggtccactactatggctccttcctgcagtccaaaacagattggaggtttctgtgagacaggaaggtggccctctcctcgctctgggaaaggtacatgctgctttaggaaggacccaagagaaagttaagaaaagttcacctgcccagcacactctacagcaaaatacaccttgctgagcagcaagacaaaagaagcccctgccaggtggccctgagctcctcctagaagttgttaactcaacagtacaaatacaatgagcgcactccataacaagtctccctcatgactaagtgcatttatcccacagataatatttcatatatccacccacctttgttctcatcaaaaggatatcttttgagttgagtccagctcctagaaaatacctgacacataataagaactgaataaatattgctcaatgcatgagtaagatttttaagtaaaaagcagagaacacctaatggaaactgctcttaaccccagggaactttaaaaacacaacagcgttctgacatccagtattaattttcacacaaggtacggactgagacataaataagaatctttgggtgaaaagtcttgacaatatctgagcaagaatgcagtttttcactgaaatactcaccaggaccacttcgcttggtatgagttctaacactgatctacagaagaaaacttctatcttttttttctttttctgagacagagtctcactctgtcacgctggctggaatgcagtggagtgatctcagctcactgcaacttccacctcctgggttcaagcgattcttgtgcctcagcctcttcagtagctgggattacaggtgtgcgccaccacgcctgcctggcaaatatgtgtatttttagtagagaggggatttcaccacgttggccaggctggtcttgaactcctggcctcaagtgattcatccgcctcggcccccacaatatgctgggattacaacagatgtgagccactgtgcctggctgaaaacttctatcttgacgcaattgttttcaaggacataatttctactactcatgtcaattaaattatcaacttctatttattgagcacctattgtgtgccaggccccacaccaggctcttcatatgtgtaaccaataatcacaacaaagagtcaaatatattatgtgtatgtagaagaagagaaaactgaggcttacagggactaaataatttatccgacatcaatgctggtaaaatattcaaatgcaatattcaaacccagacccagctgaccctcccacactgccatactttccccatgttgccaaaacactgctttccagagcacccagattctgaaggaggcccaggagaaactcacaatacccttggctggaaacagggaaacactcacgcacacacaaaaggagaaatgtttcaaaatatgtctctcgtgaaattccacttttggtacagaagcacatattgaaagaagagtttctctccccatcatgttgggctttgcatctccggttgctgctactgctgcacttcttggcacagttaactgcccatgtgcaatgtcatcacatgtcacatccatctaccatcacaaatgttgaaatttcaaccaagcagcaatagaaaaaggctgcttaatgcaaatcaagtatcagtcccagcattccaattaaggccctgcttaattcaataagtaagagtcacatttcaaaatgtttggaagtcatttcatcctaaagccttcctcagaaatcatctttacacaaaacaatcctgatcactcattctactctaactcaagagccccattttgaagagaggtctcttggtaacagcagaggggcagaagcagaacctgagtgctccacaaacccgagatatgcagaaagcacctggtagtagccaccttaatcaatacctggtcataaaccaacgcatccacaaggcacaaccacaacacagcaggatgggacacagtgtagctgacggttctgaaggtgcatttccctgcactctgtcacgctgctaatcctcccagagagatactgtcaggttgaaacctgagctgttaattatcagatgatgagggctaaacagtcattctactatgagtataattcaggcattgtgtgagtggagggattttaccgggttgtgtacacaataggtgtttaatgagtaaacagaagtgaaatggaatgaatgggcacagcaccggaacaaattacaatgtcttctaaaaacacccatcttttccaaaatttcaatcattccagctgaaagggtgagcatttgtcatgcagtgaagcagcccaaaacagtccaagaaaatggttttgtaacaaagttttgtaccattcataataacctttcaccctctatgattcacagcacaaaaaagaccaacaggctgcaaatgtctgcacaagtcagcttctctaactttttaggccagttacttagggttgcaaagatccctgtagagaaatataccttactttaaaattataacatgggaccaggcacggtgactcatgcctttaatcccaacactttgggaggccgaggtgggcagatcacttgagctcaggagttcgagaccagctgggcaacatagtgaaaccctatgtctactaaaaatacaaaaaatagctgggcgtggtggcaggtgcctgtagtcccaggtactcggaggctgaggcatgagaatcacttaagcctgagaggcggaggttgcagtgagtcgagatcgcgccactgcactccagcctgggcaacagagtgagacagatctcagctcactgcagcctccacctcctaggctcaagcgatcctcctgcctcagcctcccgagtagctggaattacaggtgcccaccatcacgcccggctattttttgtatttttgtagagacagggtttcaccatgttggccaggctggtctcaaactgctgacctcacgtgatctgcccgccgtggcatccgaaagtggtgggattacaggcgtgagccaccacacctggccgatacaaaaactttttgatggtcaatcaaaggtatgaatcctgaagtgtgtttctaaggtcacattctagggtatgatctgggaacagggtccagaaactgagtattcttaattctctgggaggaccaactctctataaagaattcgtgctgcacaaaatccaagagtattacaatttcattttattataataaggaacatctctttccagatacatccttcctccaggaatctttccctggttttaagagaatctatctggtgagtagaaaaccagaatcctggatattaaatgatgatgtttggggtagcgagaggaatttcaccagagctctcagaacacctagagacatatttgttctggaactatataaaacactctgatgaccaaactgctcaggctcaccagtattttttggttaagaatgaatgggtattctcatagagtgcttctctgaactattgattcctaggctgaaaaaacttcgtcggaatttttctttgcaatgttattactaagtaagctaaatagtgtggtctcatctaattccagggccttccaactgtgacagcccacaatgtcatctttatgatgggtttttaaacataaatagatatccatcttcccatcaatggtttcaagactttttttttttaaatatgaagaactctgttttcaaatgagctcttgcttagtattataatagtaaaaacatgaaaaagcaggtcttctctgattgaaacaagcacaaaaaacttttggcttaaactcagccacacccagcttattcttcccattcaccctttgggagatggcccaaaagtctgaaagaacactaagaacacttagaataccactgaactaaattatatcacaaactcccagccagccgtacttttctacaaaacaaagtcatgctgtccaaggaaaagcctcacattccgaaagcattagtgcttgaagtttctccagtgagcaagtctactcaccaggattggcttcaggatgtccatgttggaacgaagtactcgctctgctgcagccagtttctcccttggtaggccacaaagctcagaaacttcttggtcaccaagttgaatcatctcttctgattttgatccattgcacagacttgtcaaatgtaactggtagccttgcaaaaatacctggaagcatttcatgcaaagagagacaagcacaagaggattatgaagattggaagctgggtccttgaagtcttttggagaacttcatatcaatacagctttgaagatcttaaaacaggttccattgcaacagtccaatgcatcaggtctctttactgaaactcagaatgtatcaaagcacaaggcacaatgacaggacacttaaaacctgcaagttgcattaactcagtatctcccacactcttgtccctcttgcaaagaaaaatccagagtccaactcgttttcttaagagtgggacacatgatttggcaaacaggaatccagagtctgaattcctggaaccacttttattagatgaacaacatcctcactattttgcaatttatgttgtctttaagtaggactgggctgaaatatggggagaaagcatttatgctatttatctgtaagtgtagatatttaactaagacacagaactatgttctaacaatttcagaatttggaattctccattttacttgccctagagcagagtgccagaaagccaggcctcttatctcattgataggccaattctaaatcattcttatcttttctttataccaaacccactagagagcctcttcttggtcatattttacttaattgcctttctggacctaaactattctacttcatacgtggtccagtggaccacaagctttgaaagaagagcctgtttatcctgctcactttgcatccacagtgctgaaacattatagccagtatttgttgaaggaatgaacaatgcagactctttattacaccattactaactgccctgtttaaattggggcaggctgatgtgcttgtagaacaacctaaggtgagtgatggaccaaaagcctctcaaaacccatgcagcttttgaaatactgcagaacatttggcctaccatgattcccattaagtttttgctgactgccagagatactcaagcacacttcagttctactcatttctttaactggtccttgctgctaggctgtcagcctacagttagtgtctatgtttaagaatactgacaacaggccgggtgcagtgggtcatgtctgtaattccaacactttgggaggccaaggcagacggatcacctgaggtcaggagttcaagaccagtctggccaaccaacatggtgaaaccccgtctctactaaaaatacaacaattagccaggtgtggtggtgcatgcctgtaatcccagctactcaggaggctgaagcagagaatcacttgaacctgggaggcagaggttgtagtgagctgagatcacgccactgcactccagcctgggtgacagagcgagactccaactcaaaaaaaaaaaaaaaaaaagaatactgacaacggagggcctttgttgatgtcatcttctgcctctgcccaatcatgctttgttccctttcctttccttacacaagtattgatcccaagaatttttcaataaatgtcttgtatgctcaaaaaaaagaatactgaaaatacagaaactccaaggaccatccaaggaccatctccatgcttaggatgccccttattttaaactgattagatgtgacagatatgaaattggcagggggcaatggaaattatgctaaatgcaactactttcaaaagcctgatgcctttggcccatctcctaaccacacaattggtaaacacaaggcatattttcctagtttcagaagggcacgcagtaagcacatttttctaattttaaaaattctagatcatgtgaagcaaaaagcttattttcaagaataaacatttccactacttctgcttcttgtaaagacaagctagtatgcagacacgagataggggaggaagcagttcccctttctgccagagaataagctcaaaaagtgtctctgaaaaatcaataaccatgcaagctgggtctggtgctacccactgcacaagagctgtctaataatgatgccagaggaagttttctatgattctaaagttaaaattcaacataaacactaatattatttcctgattttataaaattctttttttttttttttttttgagatggagtctcactctgtcagccaggctggagtgcaatggcgtgatattggctcactgcaacctccgcctcccaggttcaaacgattctcctgtctcagcctcacgagtagctgggactacaggagcatgccaccacgctgagctaattttcatatttttagtagagacaggctttgccatgttggccaggatggtctcgaactcctgacctcaagtgattttcccgccttggcctcccaaagtgctgggattatagacgtgggattacagacctttgaagtgatctcgtccatcccacctgagctttgtgacactagtccgttcatttctgtttccccagtgccatctcacagagctaaaattggagagatttaaagccttattcccacaagctgcagggactgatctcctatttaatgcaaagcaagcaacagttctcaactcagtgccactgcgtccagcccttattttataaaattcttaaaagtctccaaatacacccttgtctaaagtctcctgtcctcaattttttagacagagctcctccagatcaataacccttaaccacggttattgcctcagaactgtgaatattttttaagtttaactcaacttaaaatgtatcccttgtaggaggaaatcatcacaaatgccaagtgataagccagaaatcaattttattttaaccagctggcccatgacgccaggttgcatattccactcctggatggtttggcaattcctgcctgaatagggaagtaaaattaagtgaagttgtattcaaactacctccctccccttcaccaccattacaaggacaagggtttattcatttctttccagtagctgcacaacgtaattgccatcagccctactgaggaagctggaggcatcagcttaccttgtggagaatgacatcagccctcagcatcttgtccacagtagactttgggagagagaggttgtgatacaggaacccagagaaggtttcattgtccaccaggaaatcttgaagcttcaagtctattgagaaatagtgttttatttttatttagtaagtaactcaaaaaaaaaaaaaaagtgggcacaatgggacagtggagaaacgttatcataatattgatgatcaacagttgcctggctaaacacacacaggaatgagataggggagcatcgccatatcaggagaggcatgaaaatattgctttctggtaacatgttgagccacactcagcatgtgctcctcaactcaaacagtgtgatggtgctgttacacacacacacacacacacacacacatacacacacacacagcctttccttttctttttttttttttattttgagacggagtctcaccctgtcacctaggttggagtgcaatggtggaatctcagctcactgcaacccccgcctcccgggttcaagagattctcctgcctcagcctcccgagtagctgggattacaggtatgcatcaccatgactggcaaatttttttttttttatctttagtacagacagggtttcaccatgataggcaggctggtctcaaactcctgaccttgtgatccaacctgccttggcctcccaaagtgctgacagtacaggcgtgagccaccatgcccggtctttctcttctaaatgatctcacccaccccacctgagctttgtggcactagtccgttcattcctgtctccccactgccttttcacagagctaaaattggagagatttaaagctttattcccacaagctgcagagactaatctcctgtttaatgcaaaacaagcaatggttctcaaacttaagtatgcatcagaatcacctggagagcttgttaaaatgcagactgccgggccgggccgggccgggccgggccgggccgggccgggccgggccgggccgggccgggccgggccggcccccacccccacccccacccccacccccacccccacccccacccccacccccagagtttctgatacagcggccctgggatgcgactggagaatcacttacaggtgatgctgatgctgctgacctggggaccatgttttgacaaacactggcagagtgcattacgcatatcaaagtgccttcacagacatggtctcattttcattccaaacataaaacatgtgatacaaagctccaaaacccaggtctgccaggctttaggaaaacacattaacatatatttaaaccatcagccctattaaatgatttgattgctaaaggatttcatacggaatctccctaaataataggccctctgagtacagttagaaaaggcttcaatccagtgcaacaaaacagaaaaagcagcactaagaatccagaattttagtttctagagttggaggctgtgtctggtggcgtccctgcgtacctcatgtcatctttctgaacctcaatttcttgatctccaaaatgagaggtttctgaccagatgcttggtaggagccctatgactccgaaacagtatagttttccctgactcatctcatttggctgtctacctcttctccttccaacccactctcctaacagcctaacttctttgtaataaagataaaaccagctcatcaggaccacatgaactgagcccacatggccaggcactaagcaacctctagagggcaaactttgcaaactgaaatcatttaccagaagagaaacaggtttgatctgaaaatggggctacagtgtgaggcttaatgaggacaggagttaatccgcggagctaagagggtcacatgcagagataaagtaacaggagggcctgacagcccagccagtctctcataaatgctgtatgatccaggtgtattctgctttaggcaaacttcagtaatattgagttatatagacagaataaattgagcaagatttacatcgctagagaaatgattcactgctacccctctatggctagctcctagttattcctcatgacagccagtagctgttcttaggcccagttagtgtccctcagaatcagtgctcctgcaaactgctacctacctgatgcttcccatcacatgtgactctacactgttagcattaggctctctactgcagttgtcaaacctcagagcacctaagcttcatttagggagcatgcgaaaatgcagtttcttgggcccagtccccagagattctgaaatagtgggtctagagtgcagagcctacaaatctacatttgaataagcatcccttacacttttaatgttgggggagggaggtgtggaaccacagtttaaggaacattgttttacttgcatgttgtctctaccagactatgcctataggatagggaatatgcgttcttagtaccaccaatgcccagatcaggcctggcacagaattactgcccagtgaagggtagctgaatactaaacactaggagatgggattagggctgacaaggttccaaaagtatctgagtaccatcataggagatttccttttagctggccaggtccaggaagagcccagggatgtcaggaccatccccaggccacaccccaggagtgaacaggacttctaaccactggaactgccttcccaggaacagaaagcgacatccggggtcactttctgttcttgggagaaacaggaaggaaggtgtaagctggtgtcttcagttgaggactggtgtgaaaaggtagacattaatcactgtacaaccatggaaaaagcaccaccctgggagtcagaaacctgggttctaaatccatttatttgtcgagtcatttcatgtagttgtgcctccactgccttatctataaaatgaagggtcaaaaaaggcctctgtgaaacctcaacagaaacagaatacacgtattagctaaccctcactgactaggtgggccatagcttcctcctgagcagagccagagcaatacatcatattgcaccagggaacttcaaaacagctccctccttcccaagcagggtggcagaagtgtgggagggcgacccaggccacccctgcaatgggcctaggtcatcctgcaacactctccagaccagtgagtgtgctcagcatgtttataagacttctgttatgttaacaggctctgaagatgagaacatctggatgtgatcaagctccagcctcctatcagtgaatcccccggatgagacataagaacccagagactgattaaacagtcaacaacccttggctgtgcacgtgcatggtgtggtaggttcgctgggttgggaagcagcagggagggccaaagatcctccactacaaagaacttgcagcctgatcacgtggatatccacccatgtaggcttagactcacacactagcaccaacctgtgtgaaaacaggaaggcaacatggtgtagtatactggttctcaaacatgactgcccgttagactcagctgggggcttcacaaaaatcccaaagcccaggccacaccatggagcaactaatgagaactgctagggtaagacccaggcatcagaatttaataaaacctggctgggtgaggtgggcagatcacttgaggtcaggagtttgagatcagcctggtgaaacccagtctctactaaacatatcaaaattagctgagtgtggtggtgggtgcctgtaatcccagctacttgggaggctgaagcaggaggatcacttgaacgtgggaggcagtggttgcactgagcagagatggcaccattgcactccagcctgggtgacagagcgagactctgtctcaaaaaaaaaaaaaaaaagaatttaataaaatttttcaggtgattgcagccaagtctgagaaacaatgatgtgggggaaacatcagggtttgggaccagaaaaacctaaatttgatactgcactctcctgtgaaatagctgtgtgactgtgagaaagtgactttacctccctgagcacaaattttcttaccaattaagtgaaggtaatagtatccacatttcaaagatatgaagatcagagatactcatcatggtaggtgctcaatatatggtaataatttgtgattatcaaaaagattttttcactcaactttaccaatgtacaacaatgccatttatagaaaagatggggacacagtccctgccttcgaggaactttcaaggctgaaaggggagataaagaggcaaatcaattcaagaaggcagaaggaaggataagcaagccaaaaggagacagtaaatggaagcactggcccaagatgaggtttatctgtaagtgcttcatggcgagcaaccagactggagccaagttctggaaaaggacagagtcaaaaatccctagaagtggctggagaggaaggggtaagacctctcatgatgacaacgaccaggacattttgtggtcataatgctatgcacatagtagattctcaacaaatgaatgaacaagcagataattagagaagagatttctcaaaacctcagatctgggtagtaggaaggggagaaaaaaggagggggtgaggacagagtacagtggctttgtatctgctggtctcagtcttctcccctatgttgctggcaggaaaatgggtggaaagccaagaatattaagaaagccagatgtctgaaacataccttctcctcttaccccatcctcatgacatggcccatgagtcacctcctccaggaagcctgccctggccttcccatcctcaagctgggttaggtggccagcccttttttgtgactttttttttttttaatacagagtttcaccctttcacccaggctggagtgaagtggcccgctcttggctcattgcaacctccaaagccccaggttcaagcaattctcctgcctcagcctcccgagttgttgggattacaggcacccgccatcacgcccagctattattcctttttgtatttttagtagagttggggtttcatcatgttggccaggctggtcttgaactcctgacctcaggtgatccactcgccttggcctcccaaagtgctaggattagaggcatgagccaccgcgcccggcgttttgtgactcttttgtgcccaacatcctatgttttccactagtaccacacagatcaagctgcagtcacccatgtaaatatcctgctcccagaagaatagaaattccttgagggccagggtttttaattccaaagccagcagtgcctggcacagaggaggcactcagtaaattggatgaatgaatgaatagatggatggatgaactaatgaatgaatgaatacaaatgagtgaataaattaatgacctgatgtgatttggggaattgccgattgcagagaagaaaattcaccttgcagtgagttagggaaaagatgaagcaggacatgaacttgaaacaaaccaagtaaagaggacacaagagttctgctaaacccactcagccacgtcagcccagatcaagaggagagtcaggtgagtggcagctagaagcagagtggggaacaggagagaggaaggctgagttgattaaatgataaaatggagatgacaatggcatccacctcattggactgagctaggtgttaaatgagcaaatgtacctgcagacctagtataatgccgggcactgagtaaggtgcccggtaaaggatggctaatatcatcatcattttcaggaatgactgatctgaacagattcatggctaatttaaccttaaagcatattcagaatagacaagacacagaagtggctttggcggctaagttgagatgttgaatttgtgatctaaggtatgcacatgtgtgtatgtgtgtgcatatgtatgtgtgtattataatacatattagcctggctgagttcctaagacagaattattgagttctttctgctgatactatctataaggtaaaggaaaggttgaagctgactgatttgtctactcataactttatgaaagaataaataaatctagtattttacagggaatcaccaggaatgatcatatccaccagtcactgcaaggatggatataggtggaagatgacctggacgaaagaccaatcattccacacaagacagggaatacttcctgaacaggagagtcatttagccacttaactttggccaatgagttaatgcggacctggattttataatcagtaaaatgtgtgggttggagaagatgatctctgaggtcttcttacctgacactgaaaggaacacagggcaaaacaaaatcagcactggatacagcatcacagggtctgaattcaagagtcagctctgccatttcctgactgtgtaatcatgaagctatactttcccccctatttaaatctccctaagcctcagtttccttggatataaaatggggctaatacagcactttgggaggccaagacgggtggatcaactgaggtcggaagttcgagaccagcctgaccaacatgaagaaaccccgtctctactaaaaatacaaaattagccgggtgtggtggcgcatgcctgtaatcccagctactcaggaagctgaggcaggagaattgcttggaggcagaggttgcagtgagccgagatcacgccattgcaatccagcctgggcaacaagagcgacactctgtctcaaaaaacaaacaaacaaaaaaaacggggctaataacattcacaggttgttgtgcaaaccaaagatcaagaacgtgaacgtgctgtttcaggggaaaaagctgacttgctccaagtgttcgctcgggtaactggaaggtatgacctctgtcacaggatgcggagctgggctactgctgccagcagaagagaaagtcactatccagcagaaggtcaagagggctctcccaccacagtctcttcaatacagaccaaaatacttgacctgctgagctcagcctccttggttttgcctggaggagcaaacagtgacctaccaattagccaagagcttctgtaaagtggggcaaaggaaaggaaaaagaacaaaaaacaggtgacatgtgtgtttgtgggctggaagaaacgaagcagaaccctcagcttcttgccacacatccaggcctctgggaccaagccggggaaccagctgggacctctgggacccaggtccaggcctctgggaccaagctgaggaacacatttgcacgtgcaggcggaggggtatgacgcggggtgggggcgaggtcctgctttccaggccattcagtgttccttcagttctctgagcatagaggacaaggaaggtgggaggagggaggagagggaagagaggggtgaaggagcttgggggaggctgggaaagaaggaggaaaggagaggagggagagcagctcaggaaggcggaggaggaaagccctttgctgagctgagctgagccagacggggttactctcggtcagtgccctccagtccccagctcaggtttcaagatctgtcttctcttttgctcaacatgaaaaggaaccagagcaatcagctgctttagaagtgggtggaggaggcaaatgaaaaaaaaggagaagtagggaaaatcacatcagcatcccaggcccagatggtcttcttcaatggacccctggggtgggggtggggtggggcctcccagcctgctaggagctgtcaactgagcagggcctgggagcgggagacaaattctaactcgtggttttaatcagcctgagcttgtccagccttacaaataagaccttgaaatacttctctgttatacaagggctggtaacaaatacactccagtgtctttatggtatttttttggtgttttgttttcctgatgctctgctgtcttcttgaagaatagacgatgcctgcttcaccaatagctgagcactctctgggaagacctggttgttgggtgctgaggagaaggggtgaggcggggtgatgcagctgctccttcaggtgactccttagagcaggggagagtaggccaggggtgtgtggtacacacagcctaaggacacccatgctgttcatcccggcctgggctttccaacccaggagacacttccttctctacagagaaggctcaccgagggataccaagacatacctgaaaaaactcagttccagaattttccagttatgtggccttgggaaagtcagttaggctctctgagcctccatttttctgtaaatggaggtctagcttcctatacgtgtgggttaagttatcactaatgacactaagtgtgttaagtactctgaatgctgactcacacatactccttgagaaaatacaagctgaaaattaaacatgttcaaaataaatgtggataaagtcatagatgacaagctgtgaagaattcccaagagaaaccaggatatttaggcttatgctccctgaaccttccaaggcattaggaagccagagtcttctctttcaaccaatgggaataccataactttaggaaccacacattccttctagtattttacaaataatataaacttgtattagttcaacaaacttctgaatggctacagtacccaaaatactagtgttgtggttcaaagggataatatttttctcagtgctccttgaaggcaggagctagcctataacaaaagaggcgctgtgtaacaaaatccctgcccttgcattctaagaggagatggccagagggtcgggtgagcagagcggtgagcctccaaccctctctgccactccagaatcagtcagcactggaatcaggggtggaacgagacattactcatcttcccccagattactttgctagtaaggcaatagcacacctgctatgatttgaacgtgtcccccctcaaagttcatacattgaaacttcatcaccaatgtgacagtattaagaggcagggcctttaaggggtgattaagttatgtgagcagtgccctcaccaatagcattagggcccctcacagataccatgagtttcatgtgcgtctgtgtgaagagaccaccaaacaggctttgtgtgagcaataaagctgtttttttcacctggctgcaggtgggctgagtccgaaaagagagtcagcaaagggagataggggtggggccgttttataggatttgggaaggtaatggaaaattacagtcaaagggggttgttctctggtgggcaggggcagggggtcacaaggtgctcagtgggggagcttctgagccaggagaaggaaattcacagggttaatcactcagttaaggtggggcaggaacaaatcacaatggtggaacgtcatcagttaaggcgaggcagggccttttcacttcttttgtgattcttcagttacttcaggccatctgggcgtatatgtgcaagtcacaggggatgcgatggcttggcttgggcttagaggcctgacaatgaggacccctataaaagggcttgagggagaggcttcagtcccttctgccagttgaggaaatggcgtttgtcccctcctaaggatgcagcaacaaggcaccatcttagaagcagagagcagccctcaccagacaccaaacctgccaacaccttgattttggatttcccagcctccagaactgtgagaagtaaatttctattgtgtataaattactcagtctcgagaattttcttctagcagcagaaacagaataagacaatacccatgtcttactgagaagagggaaggtgggagaagttactggaagtccctagaatgagggttgaagaccctgaatggtaacaattcccccaaagagccagtgcagccccagagggaaaggatgtcctggtcacactggccagggcgtggaagggcacagtcagcctggctttgaagctcagaaggaaatggaagataacactaagacataacattgacccaaatgaattttggacctgaacagaatgagaagaagaaacaaagaaccaacatcagaaaaagcaagaagatagctgagatgaaaactctacctgaagaccagagaggcagaaaaatgagagaggacagctggaagacaaaaggagtgaaaagaaggtaagagataggaagtatgaagaaacagagtccagaaacaggaaagactacatcaaacagaaggggaagagagaaaaagaaaagagagtttgaggcattcagttcccaaggatgagctggtctctcactgaaaaaagggaccagacacttcaaacaccacacaacatgggactagaatcagcctgcagggccctgagaagtccaggcacaaaaagaacggaaaaagatgagtttacaagttggggatgagattcttcctaaggctggtctagggaagaattaacatacacaatgtataaatagtttaatttttttctaacttttaaaattaacaaaatttattaagggacatagtagtgctttgtgggcacagaaaagtgactcatatttaccaagcattaggcacactattagcattattttccagaatctttaagaacagcctataaagaaacgtattattattcccatttttcaaatgaggaaacagatctggagaatatcttgctcagggtcatagaacaaacaagtggtaaatttgaacccaaacagctttgactgcaaagctttggttctttccactatatcagcaatttaatgagatgttttaaaaatgcttcatcgtgatattggcctcaaaagctggggatggcacctatgcttcctaatgttggaataagcaacatggcagcatagtgtggggagaaaatgctaagcctaggagtcagaccccgattcaacgtacaactttactctttaatcttggacaacagacattaccctttcgagcctcggtttcctcatcaatgaaatggagataataataccaatttgcccctgctagtgctgtttgaagccttcaatgtaataatatatgaaaaatgtaaaatggtatcattatccggtgcaacttagtctgttgaatagtgtcgcactgagattgccttttggtgcctcaatgcaacagtgacaagaggaccagaaatgggaaagctttcaatgagaaacaaactggactcccaaattgctctttgccacccacagaataaataaaccttatgctggaaaagcaggagacacgcaacactgttcttgatgttaacaattcaaaactttttaaaggcagtctgatatttgtggggatacacactattctgtaatcgaatgcaattgtgttttctattcttgtctgagtaaagctgatctttgatttgatttagttcaagtaatatttcaacattgcagtgcagcgttgctccccacccccacctgcttacagcccagctgggcccaggcccttgccctggatggaaatcaaagacctggtttctgagatgcagcctggctttgacaggtctgggaaaactcatggtagtggaaaggtttccaaatataaaattctaaggcctcaaatcaaaacttttgacaagtgcatacatacagaacgtgaattgcaatcacctaaagatttcaaagaatttccattttgatgacataatgttgacacatgtatcaccagatctcccaacaagatgacacactggggttccacaaggacagaaaatatagtctgaggctgtaacctcaactttagcagctgcctgaatgggtgagggggttcagacagaaaatgagaagtggctgtgagtcacaggatgttctttctagatgggccttgggaaacattccatcggtgcctgaagccaggaagtggagtgaatctggcatttctttcagaagccctcttgtctcctttctcatcccagccagcccatgccccatgtcctgtgactttagggaagcttctggctactcagagctgctctctttaggatataacaacaacagagcacgagaaactggaattctggtcctattactgccccttgccagctgtgctttcttaggcaagttacttggcctctctgaacttcggctccttcatgtgtgtatcccctgcattttatgatgattgtaaaaatgcagtgagcttaagaacaagcctggtacctatgctgggccaggcactgtactaagtgcttccccttattcgtccattaatttgccacaatagtcctgagggaggtactattgttattccatttgaggaaactgaggcacagagatgtatggaattatccaaggttacacagctgataagcatcaagccaagatttgaacctaggccatctggctgccaagtctgttctcttaacacgaaggtatatttcccagggaatatttacaagatgttaattttctacccacttccctcaactccctgccacagccaactatcttgccatgtcaccaaagccaccctgctccctggagctcacgtctttttgattttcaaaaatcaaaccagaatcaaaggtccaccccactgagtccttagtactatcagtaaatctgacagccagagaggcatgacccttttccctaagtaaaatccagtataaccctggggactaatttccaaaaagattagtcagagccatatcagaaaggccaaacaggctgggcatggtggctcacacctgtaatcccagcactttgggaggccaacgcacctgaagtcaagagttcaacatggcaaacatggtcaggagttcaaagatggtcaggagttcaaatggccaacatggcaaaaccccgtctctactaaaaaatacaaaaattagccaggcctggtggtaagtgcctgtaatcccagctattcgggaggctgaggcaggaagaattgtttgaacccgggaggcagaggttgcagtgaaccaagatcgtgccgctccactcactccagcctgggcaacagagtaagactccgtctcaaaacaaaaacaaaaacaaacaaacaaacaaaaaaacagagccgggcgcagtggctcatgcctgtaatctcaacactttgggaggctgaggcaggtggatcaacaggtcaggagttcgagaccagcctgaccaacatggtaaaaccccatctctactgaaaatacaaaaattagcagggcagccagccgccccgtccgggagggaggtggggggcagcccccgcccggccagccgccccgtccgggagggaggtgggggccagcccccgcccggccagccaccccgtccgggagggaggtggggggcagcccccgcccggccagccgccccgtccgggaggtggggggcgcctctgcccggccgccccttctgggaagtgaggagcccctctacccggccgccgccccatctgggaggtgtacccagcagctcattgagaatgggccatgatgacaatggcagttttgtcgaatagaaaagggggaaatgtggggaaaagatagagaaatcagattgttgctgtgtctgtgtagaaagaagtagacataggagattccattttgttctgtactaagaaaaattcttctgccttgaaaaaaaataaataaataaaaattaaaaaattagcagggtgttgtggcatgcgcctgtaatcccagcttctcaggaggctgaggcaggagaatcgcttgaatccaggaggcggtggtcgcagtgagccgagatcacaccactacactccatgcactccatcctgggcaacagagtgagactccatctcaaaaaaaaaaaaaaaaaagaaaggcctaacaagccagattcatgccatgaacataagggaagtggcagctgagccactgactccacacaaaagtgcagctgaagggagagagaaactccatactcagtcgggatggcaggctgctgccccggatctctctgccagtcctgtccctttccgccccttgacctcaacaaggtgatatgtcctccaaagggttcatctccagcacagtgacaaaatgcccaaagatatttcttatcttttcctggcaaaatccttataagcttcagagagctccacaaccttaaaaaaaaaaggtatttcagaatcccccaagtcaggagccaaagtaggccagttgcagccctagtcctcactggagaaggcaagataaggaactccaggccatggcagagaaccatgtaggctgtgcactattcaactcaaatcatcacagttctcatggagagtgccattcacagggaccgcggtgtgtatgtacccccagaaacgtgtgacttgtcagccctaggaacagcgtgaaagccatccctacccgttctaggcatattcagcaggtctagaaaatgatctttgcggtcccacaaaacacttactgggcttctagagttaaaaggtactggtgtggccataactttggacagggcaagacacctgcagagctaagatcttgcttgactcagaagttgctgagttccatgtacagtagagagaggctacctggcttccagccacaccatagaatccacagccctgcccacaccacttgggtcatgccagctaaaaaaagatggagaacttccccagatgccccacaagtctaggaattgtttccagaccagcataagcaatggcaaggctgagggactggctatgggggatgtagcagtggacaagagcctcgctaagtgtggaaacggggaacagagggaagctggggaacttctcagaggggatgtgaggacgccctatcccgggaaggcaagaggcttcagctccagcatatgcacttcccaactatgagccaagtaggacgtcccaaccactgcaaggaggtacctgctcaagaggggactgtgtccacagtgcaacctggagttgaatgagagtctgtagtccagatttcagaatatgggagaggagcaggccttgggaccaagtggatgcctgagcggaaatgttcagtaggaagcaggctaatgaacccattaggtatcactaagcaatacattttaagtagctgaaaaggaaatacacagtaaaaataagacagcaaagggtcacctccttctcccacccagtcatgattctcagcagcaacaaccccatcagaaaggccttagcttgggccagtctgcttctcagcccacctaagaatgccagattcaccagagagggggcacagcgatggcaggtggcttggagtggggagtgaggatgactccagggcaaggaaggaagctttggaaggggagcagtgcttcttgccccaccatgccctggcaggagcagatgcaggtgggggcctgaggctgacacaagttggtagggggctctctttttaaaacaagatagtatttttaaaaaatcttacttttgcaaaccttacaaaaacataccactgtgtaaacatattgctaagacccccagagaggaccttgaaaggagctatgaaaaataaagtaaatatttttagcttcccagtaaatctactttaggcctctgggttcatggctgcccttccagaaagctctggggggcaattttgtgaaagaaagaaggccaagactttttgaagaacttctgtcatcattattattcgtaggctctgttgacctgggctaacacaagggaataaactatataatacaattttttaaagcacttttacttgaccctcacaataccctgtgaagtacaggtattttattttctcccaccttcattccacaaagattcactaatggctcaccatgcacccactactgtgctggggcttaggatggaaccatgagcaaggcgcccaccttgccctcaaggggctatagtctagcagacagcccacatccttgggtagtcccaggtgatcccccatccaagtactgaccaagtttctgggctgaagcattttctggttgtttcaccaaagaaagttccaatttcaaggcaaagaaacttaaggcccagagaggccgaacaagtggcaaaggccaaacagtcagccaggaacagaaggggaagcaaagcaactcgaatttattatgtgtcaactgtgggctatgagcttcactatcagtcatccacagacatcatctaatttaatgctcagtgaccctcagggcagctaatcttcaggtaaactctgggccagaaagaatcaacacatgcccaaagttcacacttcatgagggatgcagcatggatttcttcccaaaatgaatcttaatacaaaaccccacactcactcttataccaatgttttccaatcttcaatcatttacaaactactctcacaagttttaccatattcacagaaaatgtttcttttgaattaactttaattatatttttcctgttgaacatcctcctaagcaataatttccatgaaattgcaattggatgtgggttaaaattaaaagttctcatccacgtactgcctaaaatcatcccagataccacacaaaactcacccagagaaacacttatctctgccagtctgtatctcacagagacaaaatacagacatgtcactttccctagggtttctgaggatttatccaatttttacatctgagttgcagtcaccataggtatttaagatgaatgaatgcttctcacactgccttgcaaacattaattaatttagccaccacaccactcaacttgtgtgcctgtactctggtttaggaagaaaataataaaatgtctaaaaagttccagtgatgagaaaagtgggtgaggcaccctgtaagacttcctccttggatttcttattaggatgatttcaaggataattaaaagatttgtccacggcttaattcctgaaatgggagttcttcccagttgaaagattattaaaacagcacaatagagcactgtagaaggagaactgcctggagcagcaggggggtttagccgtgatttattcccagaatatcccttctgtggttgtgtagacttgggacagtcacttcccccttctgggtcagattcttctctagaatagaaattccatatggagaggggccatatttgttttggacacctctgtgtctcggcacttagaacagtgattcgcatataggagacgctcaatatataagggttgaatgacagaatcaactaatttatctataaatgaactaactggtctctaaggtctcttccaataagtggaaataaaatgatgctctagccaaggaaatcatgagagtatttgagtagagatccccatatctacaaatcacctgtgtatagtccagcgaatttagcagatgcaagctgaagggaagaacaagataaacttcccaactggatcacagaagcaggagcccagtggcccagcactgattacaatataggcctgagtggtagtgtctacagaatcaagaatcacttgaacccaggaggcagaggctgcagtgagccaagattgcgccactgcactccagcctggtgacagagcgaggctctgtcttaaaaaaaaaaaagaaagaaaagaaaagaaaaaggaaattagtggtgttttaaggcagtctcctccactaagatcagaaagtctgcttgacaacttacccccatcagccagtctatttcaactgctgcataaattgcaaggcagaagaacaaggccaggtgctcagaaatgcatcactgtcttagaagaatactggctctcatttattgggaatctactatgtgccagatactacattaggttttatagtttacatttcaagttagctgctattttatagttgaggaaaaaagggtctacaggggtggttagtctccactggactgatccaagcttcaagtctttgtcccacagttatcgatgactggaatgaggccaaagagagttgtttatcacatctctagatgacgagaaaggagtatcagatataatacatggcaaaatcagaatctaaaatggttttgggaggataggatagcatagggaatctaaacatgtaaaacagaaaaaagacatttttccctttagttcaaaaagccaacaatacaacaaagaaatggagaacacgtaacttgcaattctgcctatttaaaataatcacaattttgtttgagtgcacatggaatatgagtcaacaaggtgacgtgaatgccaaaatgcctaatacaatctcagactgcattaacggaaatgtagcactcagaacaagggaggcaaaaatcccttcctcctctgtgccagaatactttcataatttccagtaaacttcaagaagcacacagacatactgaaacacaaccagaggagaggcagaaatggggaggaaaaacattccataagaggaaaggaggccattttgcctaaaaaatcatggactttgggaaaacagggaaagaaaaacatgagagctgtcttcgactatttcaaggaaaacagaattagacttgttctctagaaagcataacagggtggtgaatattttctaacaattagagctgtcaacacccagaatgggctacttagtgagtggtagatccccgccctgggaaggtgggtgtgtggtaaaggaggtgaatgaggacaaagctccaaaccagatcagcttcaaggatcctcccagccctgggagagacagcacaggagggccaagctcatcatgctgtgatggggtgtcagtgcagataaacacaggtctctaagtggggatccatactgacatatgccagtctcagcttctctccgaaattgacaagagtgctattcgcaatcagcaaaaagttggccaggtgcagtggctcatgcctgtcatcccagcccttcgggaggctaaggcaggaggatcacttgagcccaggaattcgaggctgcagtgagctcagtgagctctaagggcaccactgcactctagcctgggtaacagaaagagaccctgtctctaaaaaaaaaaaaaactaaaaataaatttaaacaaataaaataagtaaataaaaacaaaatcagtaaaaagttactgatttcctgtaggaaaaggcagtgtttctgtgcatttccccctatactgaagcctgttttgtgctgcaagacaagcaaagaaagaaagaatttaagaaacagctgcaaggcagaaaaggggacatactgcgtgaacagagagatgtaaaacaagcactgacataataatacactcaaaatctaagggaccttctctcctcagagctctgcacactactgtagggtttttagatacagatttggcttcttcaccacttaactcatgtctccagcttctcaaagaaggccaggcatggtggctcatgcctgtaatcccagcactttggaaggcctaggcgggcagatcacgaggttaggagatcgagaccatcctggccaacatggtgaaatctcatctctactaaaaatacaaaaattagttgggcatggtggagcatgcctatagtcccagctactcaggaggctgaggcaggagaatcgcttgaacccaggaggcagaggctgcagtgagccaagactgcgccactgcactccagcctggtgacagagcgaggctctgtcttaaaagaaaagaaaagaaaagaaaaaggaaattagtgttgttttaaggcagtctcctccactaagatcagaaagtctgcttgacaacttacccccatcagccagtctatttcaactgctgcataaattgcaaggcagaagaacaaggccaggtgctcagaaatgcatcactgtcttagaaagaatactggctctcatttattgggaatctactatgtgccagatactacattaggttttatagtttacatttcaagttagctgctattttatagttgaggaaagtaaggctgaggggttaaatggcttggttgagatgtcaccactccaaaaaaaatcataattcatattcactaagtgcttcctatgtgccaaatactgtttttaagcaattacatgttttatctcattaacaggtaagaagaagtggctgaaagggtgctaactaacctattcacaaagtcatgcagccacagggtaatgtatgctagcactttcctctgcaccacgctgtctcttgctacagaggtaaaggaaatatccccagctgtgcctctggtcaatcagcaggggctctccagtaaataaggaaggactgaggctttgatcaggggttgttgctacctttctgtctcctgcaccagaagaaacatccatgtgcaagaccaggacctgcaggtcaaggaaacagcatctcgatggcctggctgcacagccaggagttgtctaagtggacactccaagcacagccatacctctctctgctgtgaagcagcacctcctccatgccacccctaagacagctttgcttccctttgtcatcaggtcccacattgcccattgcctcttttactgcccaaggaaagcacagttctgtagccttaaaaaaaaaaaaaaaaaaaaaaaaaaaaactcaaatctgagtctggtttaaactctagaactttatcatttcttcttttgccaaatagaaaacaaactggtaggcctttcagcaaaggccagccaactccatccctccctaaacaccaaacggaataaaaagcacttccctggagcagtggcagccattggtccatgatggggaggagtaatttatcactgacattgtttagaaccaccggcgcatgataataataaaatgcagaccagcttttatcggcttcattattgcttctacattctctacagaccatgcacatgccattactggctgcactcagccagctgctcccaccagcctctgtccccttgccaggccactgcctggaaggctgctctgatgctatggcagccaatgcctcagtcagaaaatgcccactccccagatacctcctgggtggcacacaagaaattgcctggatacttaccagatcagaggtaaagatttcactttttaaagacaacaagttcaaatgcccatcagactaattgaaatgattaggggaaaatgaattgcattctctttttagaaagaagtgcttaactttcacttatccatatcaacttacaactgtaattgctcttatatgcacagaaatactctgtctataaatccattcactgcaaccatatggccaacttcagaaaaaatgcagttggcagcaatctgcacccctagctgtccctaaggccaagtctgtagtattcttccctggggacttttcttctgtcttcccagagaagattagtacatcactgtctgtggcaaccagctcccctagtttcttcaccaatgcctcctggagaggggccccacaggccagccaccaaggagaaaaaccccttggggaagatctaatgggaacaagccccagacacctgggctactctctttccctggtgcaggtcaatttccaattataaacggatgcagagaaggtttttacttacttgagctggatttcttgatctgctgtaatgttctcagaactttgcgcatgtccttcatgctggtgtctttctggctgtataaaagaagcctccgagcatctgagaacaggcgagccacactgtaaagggtgcaagaaaaggcgaaaggctttagctaggccaactgcctctgctgctttacagaagtgactgccaagtgcatagaactcagcctggctcccaggtcctccacaggctggccctaacccactcccatggctccccacacccagctccattcatcaccatgttccctcccccacccatcatcactgccccaaatgcctttctccattggtctacacacccaaatcttaccacccttcaaggcccggctcatcatgcatgtgcacacacatgcatgcacacacatgcccccagggccaacttatccatgaaccacagtaggctcagtggcctgggcctgggatactcttaagggcatattagaatgttttaatttattttaaaagcagaattaaaagttaatacactaaaaatgtatgaataatcatgaatctggtctggattatattcatctttataccaatgcagtcatgaaatataatttttaatatttgtgtatggaaggggcccatggaggctacaaagccagtctagggtccatgaacatgacagtgtggccctgcgtgccgcagctgcagcttcctcaggattgtcctgagccacatcccatcgtccttactccgtcctaactcacatcacggtcctgtgcatttgaagaatcctcaatgtctcatttgggggacacttattatgcccatacttatgtccaggcactgaagccaggagccaggaatacaaagggaaggggcagcatcctgctttgctcagggagctcacactcaggggagaaagacctgcagacattgtagtctgatggggcagtgacagaggtgagagaggtgacctgatgcagagaagacagaactcccctagccttggctgtcagcttcttatgggcaaggacccttccagcatgcatctttgtgccagcccctaccctctagctcctagagccagcccattcagatgcacgtctgctgcatgatatcattaacaacatatagtatattccaaaatagctagcagacaggacttgaaatgttcacaacatacagaaatgataaatactcgaggtgatggataccccaaataccccaaattctccaaaattctcccttccctcattctgcagactctatcacacaagcatttacaaaaacaacttcacttaaatccagccattcaaaattctccagaggacaagaaaggaaggaaaaggattaactgacaagtttggaaagaaaacctgatctgatacttacatggatttgttaaagtttccaacaactccgggagcctccccaggagtcgggtaacggaaacaggggttgttggcattacagataatcccctgaacccaaggaagtgttcctgcagagggcatggctttatttggaaaatggcctgttgaaatcgaggagtagaaaaacacagggagaaacattaattccctgaagcgattttgaggctccatttatacaatgcttcatgccaagtctgtccgtcccattccccacatcccagagacctgtctcttctgaataaaactgactctcaggtggaaacttggcctcacatgccattcttaatctagtggacatcatctgtagaatggggttcatgataccagcgttggagaagtgatgagaggggtcctaagcagaaagtccctggcatccttagttcctctttgacagccagcctcagctctcagacatagaggggacttggggatgccctaagcctattttttcatactctaaggaggtaactacggtaagatgaagtgggctgggcacagtggctcgcgcctgtaatcccagcactttgggaggccaaggtgggcggatcacctgaggtcaggagttcaagaccaccctggccaacatggcgaaaccctgtctctactaagcatacaaaaattcgatgggcttggtggcaggcgcctgtaatcccaggtactctggaggctgaggcaggagaatcgcttgaactcaggagggggaggttgcagtgagccaagatcgcgccatttcactccagcctgggcgacaagagcgaaactccatttcaaaaaaataaaaataaataaaataagataaagtgactgacaaagaacactcgcaaagtcagctggcgtgactgggagtagaacccccatctccatggtcccaatccaagcctcttcctcacacctgcggttagattggaatttagctcatctcaaacccctctggtactctcctccatctgccaaacatttgtcagtttcacctcctctgccagctacaaagctcctcaagggcacctgaaaaacacacaggcttggggtctgatgtcatctgtgaagcttcgggggttttgttgttattattgttgttttgtcactaattaaaacaatgaggccccatgcactaggtcatcctcttgctctcctctttctttcttacaatgagcttcttaccaaaaggatgatgggacatatttgggcttggtcctaggattcggtctggcacagtttggtttgcggccgtaatacatggatgctgcttatgaggatcaagattaataggccctggacgaggggctcttaacccaaggacctgttcaggtatggacagaaaggccagagctcctgcttctatcatattctcagggctatttgtgaccccaaaagagttcacagttatcaagaaccacagctctaggtggtgaagaacaagtagcttcacaggctttggagtcaaaccaattggaattcacatccagtccctgcagcttgctaagcagtgactttagccaagtcattgaccccataccctcagttttctcatctgtaaaatggtgataaaagtacaattaacttcacagagctgtggtgagcatcgcatgagaccttgcaggcaaagcgtttttgcagagtgcctggtgtaggacaaagactcaacaaatgagcctatgaggattttccaggcactgtgggagtgaatctaccccagcacttactctgctgttgcccagcaggaacactccttccatctcacagctaccacctccctccaaagtgggaaccttgttttattcatctttttattttcatgcaaatgggctgagaagttaatccaaagtcaggacttgctgcactttgcatttcaatatagggtctttctttcttttctatccatactccaaccagagaggcaacacccaaagcaaggatgtgataagatctgatcactgtggccaccctctgcagggactctggcctattgaacatttacacagttaatctccctatcttcctgttaatagttcaaggaaaaccaaacaaggccccttgcctaagtcagctgctcttcattcagggagatttatgtaacccaaccaaatactcaaaggaccaaaagattctcccctttcaatgccaggagacactggcactgtagacagactggcataggtgaaaagcagcacagggcagtgatggtgaaggtatttcaggttatcccttagcaggggtggcaaaggcccttccttgtacgttgtgccccatcctatttgcaaacaaaagtaggatcaggactaggcagtgggtgtacaggaagacaagtaaataatataatgggctctcaggacccagggaagtttttaagaccttgataactctggtttgaactggggaagatttacagagaatttcaaaccagtcctttgttcctagggacaagacacctctccaagtttcaccttaacttttaactctgctcttccaactaggtccctggagggtgatgagaaaagaaggtaaggttgcaagaagtgcatggatatggccgggcatggtggctcatgcctgtaatcccagcactttgggaggctgaggcgggcgaatcacctgaggccaggagttcgagaccagtgtggtcaacatggcaaaaccctgtctctactaaaaatacaaaaattagccggacgtggtggcacatgcctgtagtctcagctatttgggaggctgaggcaggaggctcactggaacctgggaggcagacattgtagtgagcggagattgcactactgcactccagtctgggcaacagagcaagaccatctcaaaacaaacaaacaaagaagtgcatagatgtaaggaaaagtctcatttaccatcagtatatacaagaatttcagaacttttctgaaaatttatgatctggagtcagaggaatctaggttaaaactcaacaatctgcccaagatcacaacctcggtgaagggcagaggcaggatacaaacaaaccccaacttgtctgatgccgaagacatttgctatttccactacaccatcttgcctgcttgtaatcattccagaaaatcattcgtctagtagatgaaaaaactgagtttgcccttgaaacttatacttcagtggtgcttggcataatgcttaaataaaatctaaaatgtatttgctcatcaatcaaaaaaatctctttggggttccaaaagagaaaacagaattatctcacaggcatataaattgcatataaatttcagtttatgcttttttttttttttttttttttgagacagagtctcactctgttgcccaggctggagtgcaatggcgcaatctcggctcactgcaacctcagcctcgcaggttgaagcaattctcctgcctcagcctccccagtagctgggattacaggtgtgcgccaccacgcctggctaatttttgtatttttagtagagacgaggttccaccgtgttggccaggctggtttcaaactcctgacctcaagtgatccacccaccttgacttcccactgtgcctggcccgctcttttcttttttgatgaaatcaggaaatcacgtctcagaaaatgtttcttgaggggtgtgtgtgtgtgtgtgtgtgtgtgtgtgtgtttaatatgactatgtgtgatgtgcattagaaaatcagcaagtaaataactgttgctatatattgtgagaaagatgggaccaggccaagaaacacaattaaaaggtggccctggccccactgctttcctggaagaacagtatctcataagcttgtgggtctcgtaggggtatggactgagctgcttagtggtaggaaaaatcactagggcagtgaaactgaagtcccagctacatttcccagctacgtaaatgttgatcctttagatctggccatttctgcagtgtcaatccacccactgagcccagccctaagagaaagactgtgattgtaagatgatacactgacaataataatatgaggtaggtattactattctctgtttaaaagaaacttaaatcacttgtccaaggtcatatgcttagtgaatgctgacaccagaattcatacccagataacctgacatctggagcctgtgttgttagccactactgtattttctatgctcactgtaaaggctgttatcaaaatacatgattgacagatgatctgagttctattcaaggttgttatgagaataaaataaaataatattagtaaaactgagaagttctacacaaatgctgcttaaaattctgtgttccatgatttgcaatgtgtgattaagacatcatgcatatggaaaagactaggtgttaaggcattatcttaaatgtgcttttaatcaccactttctaaaattatcagtaaggttattctattttcatgatttaaaatgtgtaaaagagatgttgtctactgttataattacaattatcaccattcactaggactgaaaacagtctcctgagttcatgccttatcaacaaattagaagcctaggttttctgatccaaagcatgtgtgatgtttcccaaagacagcatctttggaaaagtccaatttagcccacgttaattgcctggattttccctgccattggtgagtctcaggcaacatccacagttacttacattcatgttgttcatagggtgggtagctcagccgaacagagatcaggatcaggaagataaatagaggccaggccacttccagcagcagctgacactgagtgggaaataagatagaacactgtaaatttaaaaataatatggatatccaatgccactgggatctgggaaatccacagacaacttcatttactaattaatcaacttctccagtctctcccaccactctctaagctttaacagaactgtttggagtcccaaccttttaacataccattccatatacctctgtgtcttcccttaggtaagggaagatgcttcctatcgtgctttatctggttcacttctattcattcttcaggattcatcgtggcataatttcctttactaaaatctcagcctgagctagaagccctcctcctgtgctactccagtaacccaggcacactcctcctgtagcattttcctggagctcctgaaatcatctgtttctgttgctggcttcctcagcacattgagcactctgaaagcaggcacccatctgtctgcattcccagccttagcatagtgccaggtatgtggtgactatgttgagaggagaggaccaggccaacctgctgtgctaaatacacacaacccttgctcctctaattgcacacaaagctgctccctatggggcagagaagagggctctcaaagacaatgaaaattcacacatagttccatattgacctgtgtgcactcaggactgtaaagagagagtgcaaagtccttccccatctgtccaggtctggtcatcatcttctccgatgagttaaaaagatcattgaacttctaaacaagcatgatacactggttaaaacaatgaggtttctccaaaggaaaaccctgcctcagtgagttaccaggcgataaattagcagacggacaagatggaaatcactagacacaatataattgagccagtagtgttcagacaactagttacactgcctgaagtctatcacctctcccattcctttcatttctatattccaacgttgtaatcaagataaacaccaaagagcccaaaagagtcacagggccttgtgtttcagagtaattataacttacaactgtggcttcagagtcacacagccaagataatactggtataaaatccctttttgtcttctttttttaaaaaaagcaaaagattgggctgggcacagtggctcatgcctgtaatcccagcactttgggaggccaaggccggtggatcagctgaggtcaggaattcgagaccagcctggccaacatggtgaaaccctgtctctactgaaaatacaaaaaagtagctgggcatagtggtgggtgcatggaatcccaggtacttgggaggctgaggcaagagaatcgcttgaacccaggaggcagaggttgcggtgagctgagattgtgccactgtactccagctggggcaacagagagagactccgtctcaaaaacaaacaaaaaaaaaaagcaaagatttttttttttgagacagggtcttgctccatcgtccaggcggtacgatccggagatcatagctcactggaacgtcaaactcttgggttcaagtgatcctctcccctagggctcccaaactgctgggattacaggcgtgagccactgcactgagccaaagcagaaattttttcttgatcttcaagtccttatatttttatggaaaatttgaaaataaaaaaatacagaaaagtttaaaaaggtaaatataaatcaccttaatcctacctcccagagacaatccctagtaaactgaagtaacaatggatctctgttaacatcttttgtcttttttcatgcatacataaataatattttttctctacaatattgagactatgcagcatatatacttttgtattctgttttttcatttaacatcatactgggagagcatttcccatgacataaaatataatcttaaaacatgtcctgtaatgtctacttgatattccactctatgaatagatcataattgaacctttctgctaggtgctcgtgcttcagattgttttgggtgtttttatttatttatttatttgttgttttatttctgatatttttaaaaaactgttttttatttccaaagacctttgatatggttctacattaaactcttttaaaaaatctttttggcgatggatgcagtggctcatgcctgtaatcactttgtgaggccaaggcaggcggatcacctgaggtcaggagttggagaccagcctggccaacatggtgaaaccccatctctactaaaaatacaaaattttagtgaaacgctgtgtctactaaaaatacaaaaattagatgggcatgggggtgtatgcctgtaatcccagctacttgggaggccaaggcaagagaatcacttgaacccaggaggctaaggcaggagaatcactcgaacccagaaggcctaggttgcagtgagccgagatcactgcatgatcacgccactgcatgatcagagtgagactgggcagaaggaaatacagcaagataatgacagtggatgtactaggatgataagaacgtaggtgtggctggcgcagtggctcctgcctataatcccagaactttgcgaggccaaggcaggcggatcacctgaggtcaggagtttgagaccagcctggccaacatggtgaaaccccatctctactaaaaatacaaaattagccgggcgtggtggtgcatgcctgtactcccagctacttgggaggctgaggcaggagaatcacttaaacctgggaagcggaggttgctgtgagctgagatcacgccactgcactccggcctgggcgacagagcaagactctgtctcttaaaaaaaaaaaaaaaaaaaaaaaaaaaaaagtgatgtttttaatactttcctgtcttttctaaattttccacaatgagcatgtataaattatctcatggaacaaaaaaacactgttaccataaaactatcaagaatagtttgcatagacggcacaacagaatgaaaaataaaggcaaatggatccctctctggaagaaagcatgctgacagtggagtactcaagaccaaagatggggctggtcttgctaatatttctgtaaataatcccaaagaggcaacatactcaaatttccaagcttgggaatgacattcagccttttctttttttttaatagcaaacacctttttattctgtagcttattttttaagttgagatatacatatatatcacattgcatatcttaaagatatacaatttttatttgtcaattatacctcaataaagctgggggtgggggtggggaagaaagcaattttctttctgccaaagaacaaaaccatgactctatgaaaatgaacttttctcccagctgagccaggactccctcatctcaatttccccaggtactttgtgtctgtatcagcacttggtacaccagggaccctatttatatataagcttctcccttagggtcactttcttcttactaagcctaccacatgataatggctttaaaaatgtttggtgagtaaatgagctggtttaaaagataatgaacacggaaatataaatcagttgagccctttgggaaagcaatgttaacaatacgtattcaagagtcatgtttatcccatttgcccaattactattcctggaaattcatcctaggaaactgaacttaagatatcaaaaagctatatgcataaagttattcattcattgaaacattataattgcaaaatattggaaacaacttaattgcatagcaatagggaaatgattcaattatggtacatgtactcaacaatatatcatgccatcatcagaataatgtttatgaaacacagaaatcattagccatgtaatattaagtgaaaaaagcagaatacaaaattatatgccattccaagcttgtagctgaataaaatcacttataaatattaacaaagacaggaatacaactttccttttaaatggcatgactgtaaataaatttagaaaatacttatgaggccgggcgtggtggctcacacctgtaatcccagcactttgggaggctgaggtgggttgatcatgaggtcaggagttcaagaccagcctggtcaaaagggtgaaaccccatctctactgaaaatacaaaaaaatagctgggcatggtggcgggagcctgtaatcccagctactcgggaggctgaggcaggagaactgtttgaacccaggagacagaggttggggtgagccaagatcgctccattgcactccagcctgggcaacagagtgagacttcacctcaaaaaaaaaaaaaaaaaaaaaaaaaaaaaaagaaaagaaaatactaatgaaattaggggaaaaaaatgaagctaaacaaagagtatgagtaagataaatagccatcagccttgaagctctgaaactaccatttgtactttaaggataaatagtagctactgtttatttagggcccaatatgtacaaggcacattttatattaattacttaatttaatcctcaggacaaccctgtgagataggaaacattattgtcttgattttatatgtagcaaggctaaggctggaggaagggtaaatcacagagatagtcagtagcggggttgagatgagcagccaattctacccaactcaggaggccacatgacattctatttgacaccacgggtgactcaggtaggaaatggccccactaggtggaatggtctagaaatatcaacaggatccagagaggtaaaattaattcacagcttgtagatttataatacttacagccaatattgggcagctactgtgtactcaagacgttttgtgtatctcatctccagtatttaattcataataaccctgtgaggtaggttgtatcattaccgttttagaagtgaagaaactgaggtttgaacaagttacgagccataagaaactgcaccaatgtttgaacccagatctactgacacttaagtgtgtgcttttgtacccatcatgctgccatcacaaagctatgtttaggacatataccttttaagatatgccacttaaaagaaacctagcacttgccagccctgctgagcactgatctgacccaattaatcaaggcttatgttcctggatatctctgcagcccccatatctaggatcctgtagggcagcagatgctcaaaatatgttggttgactgaaaaaaatgaatggatcttccccatggcaactgacagcaaagggcaaacaaaaaatcttacaagccatttggagcagctgaagctggtgagtgtaagcagatcaggaaaagaggttaaaaaaaattgatgatgataataataatgaaaggtcttactatgtaccagggttgtgagtgctttatacacattaactcatttaatcatcaaacaatccaattagtactcttgttatacacattttacagaagaggaagctgagattcaaagagttaatacactgcccaatggtccaagattggcaaatggcagagccaagattcaaagccactctgactgaagggctccttctcttcgccattatggaccccaacctccttatgcactttgccttcacttaccagagcatacagacacctgctctctcaaagcccttgctgagctgggagactagcatgtatgagtgaattaaagagactgtctgcaaagttcacaccacctgagccagagaactcatgagagacaaaatttaatctttgcccttttatcttggacctctaaaattcttcccatcattgaacctagaactcaccttccaaacccaggggaatgttccaggtatttcttttcataatagcctccctctagaaaccaaagttgacttctgccaggatatgccattatggctacactcattaataaaatcagatttctcctccttctctaagcttagcacttttcctaaacataaaccctcataaatagcttggaaatgaagttgatcctttaccattataaattcctacagaaaactcttctaaatcttgctttggtgcctacccacccaaccccacacctccccatggggtgggaagatgggaagaaacattgtttttaaaaggcgtttctcaccaaagtcaaagctgctccaagagtaccgaagcaccactttgcacttcccatcttgctatttcaacatggggataatatgagcaggcactgctagagcagattttcttgatagtgaccctactgacatttggggccagataggtgttgtgagagactctcctatgaattctacgaagttcagcagcatccctgacctcaacctctaaatatcagcacatacattcccaggattgtgacaaccaaaaatatctccagatgttatgtccctggtggaagggtgagggtggggtggggtagggggataaccggccccggtcgagaaccactgctctagagttattatgagaattaaatgtatttcacatagaaggcttagcacagagtctagtacttatcatcatgttattcaatatgcatcaaaccactcttgaatcatcattcatagttatgccaacatctcccacactacagatgttcactgtccacttgattattcatgcctgacttttgctgctggctgccgaagttcatagaccacaatccagtcactctgtgaacccatttccctccctagcctgaggacacagtcacggtgctcttaaattcttgagatttagccacgttaattcaaggttagggcagcgcaagggccatgtacaaagaacagagaaaactagcagaataaaattgggccttaggcaagaggcttctgaatcatggtagccaaaataatgcactccgcgctgaaaaatgaagtcgctatttcttagtattgagagattcttgagaatataatgggggataaaaaaaggaaacaagaagaataaacatcagaaaggaagagatgaaaatatcctttctgtttctggcatggtcgtaaatctaagagaactcacaaagttaactaaaaagctgcaaatgatttgcaagtatgggtaagttaatcagaaccaaggtaaattctcctaaataatagcattgctattagtctctgaaaaccagttaaattaatataatgtggggaaaagagaatactatccacagtgagaatggacacataaacaaaaaaacctaggcattaacttagccaaacatgtgcttcttacataaaagaaaaccacagaactgtagtaggataaataaaggaagatgagaattaaggagagctaaactctgcttcttcatgagttcatttaatatccaaatttcccaagctaatttatagatttaacacaactgaacttaaaatagcgatagggtacttttttgagcttgataaggtaataacattcaatggggaaaaaacagataaaaatatcaaaagatattctgagaggcaaaaaggtaagtgggggacaatgagctcccccatatatcagaatgttcatcaaattcagggtacattctgggctctatcagcaccaaaactaaaactacatatcaaatgaccaaatgaataactccaaaattgctccctacacatctttttttttttttttttttttttttttttttttttttcagacagagtttcactctgttgcccaggctggagtacagtagtatggtcatagctcactgcagccttgaccacctggactcaagcaattctcctacctcagccttccaagtagctgggactccaggcaagtaccaccatgcctgactaatttccttatttttatagagatggagtcttgctatgctgcccaggctggtgttgaactcctagtctcaagcaatccccccacctcagcctcccaaagtgctgggaatacaggcatgagccaccatatccaggttttaataaatgtcccaaaaataactagaaaaggaatcactatttaatcaagtgattatttattaaataatcactgggatgacatgatatgaatgtgaagaaaaattaattttagacccatccctaacagcatacatgccaatgagacctgggaaaactaaagtgaaatcttaaggatcacatcagaaaaatgctagagaggggaaatgatttttaaaaccaggcctgccttccctgaactacaaagtctcatgcattgatggtggctatttaaattggttggatcctctggaaagacatctgatcagacacttcaagggccatttcccttcaacctagtaatcctgttcctcagattttggcctacagaaataatacaaaaataataaaagattaaatgtatagaatctttatagtaatttatttgtaacagcacacatggaacaatctaaatgttggcaacagggtttgaacttataaaaactgtgttaatggattactgcacagctatcaggaatgtcaaaggcatcatcccacagtagatttggagccaaaagatcccagccctcctcttagcaactttttattttttgagacagagtctcgctctgtcacccaggcaggagtacagtggtgcaatcttggctcactgcaacttccacctgccaggttcaagcaaattctcctgcctcaccctcccaaatagctgggattacaggcaagtgctaccacgcctggctaatttttgtatttttagtagagatgggtgtcaccacattgaccaggctggtctcaaattcctggcctcaagtgatccgcccaccttggtctcccaaagtgctggaattataggtgtgagccaccatgcccggccattaacttattaacaatactctcttcatctgtgaaacagaaattgcaacgcatacacctcagaattgctgtgagaatcaagaaagtaatggatatcaaagtattactttcaaaactataaaacacagcctacacatcagaaatcattattctaaatcagaagatgatttagaaatatgtgaacacgcacactaaataatgttaaatgaaagaagaaaacagcataaaatggtccatgtatatgtaatgattacaattgctttcttgggcctttgtcattcaagttccctctatcccaagagtcaccagacaatgtggcctgactacctcagggaatcctcttgcacataaaataaaattaaattctcagggggcactgtgggtcacgcctgtaatcccagcactttgggaagccgaggtaggaggatcacaaggtcaggagtttcagaccagcctggccaatatggtgaaaccgcatctctataaaaatacaaaaattagctgggcatggtggtgggcgtctgtaatcccagctactaggaggctgaggcaggagaatcgcttgaaaccaggaggcaaaagttgcagtgagccgagattgctccactgcactccagcctgggcgacagaactagactccgtcttgaaaaataaataaataaataaataaataaataaataaataaataaataaatattaaattaaattctccttccccaggagaattggccctaaatgatctggtcatgtctactaccaactcatcccccgccagtcttattcactccaccagtgccactggctttcttctgttccctgacctaggggacaggcacccccagtctctctgcctggaatggatttccctatctctaagcctctgatctttgcctggctaaccattgcttgaacttcagggctctcagctttaatgtgacaacctgtcaatctaaatgaaatccctacccacacctgctagtatctaacaccagtaccatagtttgccggattttttccttcataatcctcatcacagttgatagttatatttttatttgtgtgatgatatgtttcacatctgctggcctcactgaactgtaagctctacgaaagcagtactcatgcccagctgcttcaccactatatacccagctaaccataccacaagtaatagatgcttaatagatatttatccaaatgaaacaataaatgtctatttgttttaactttcttcattccgtagaagagaaaactaaagctctggagaaaggagttttcctaggccactgaggcagatggtggccaagctgggattggaatcatgaccactgctgccggcccaggagtaaggacagggaagaaatgtgtcaggtgaaactagaagtggggaaaggatgcagagagtttccatctactctgtaaaattctctaaaagctcataaatgaggagttttaatttttggatagttcattctttttcattaaagaatgcccaaatagtggtactctggctgggtgcagtggctcatgcctgtaatcccagcagattggaaggctgaggtgggtggatcacttgaggtcaggagttcaagaccagcctggccaacatgctaaaaccatgtctctactaaaaatacaaaaattagccaggcgtggtgctgtgtgcccataatcccagctacccgggaggctgaggcatgacaattgcttgatcccgggaggcagaggttgcggcgagctgagatcataccactgcactccagcctgggcaatagagtgagactcagtttaaaaaaaaaaaaatcacaattaactattttcccagccacatgactagtcagatctatttgagaaaattaataataaaggcaaaagaaaagaggccatgtggccaccctcactttgtccagtttgttccatggggaccttggcctctggatcagcctaaaaccagatgaggatcgtgaaagctctgaagttctcttccccttcctgtccccagccctgtttgtactgaatacctgccacccacacaagttaactgttactttggacccaaactgagctttgcacccaactttcacaactcaattcaatttattctttgcctaacagaaacagcggaaaactaaccctggctgatggtcccccctcagtctgcacaatgggggtacaggagaggcaggggacccaggagttaccagcaaaccaggacacagaatgaaaaggcaagcactgcctttcaacagggttgctctggggtataccattcagctccaggctgaacatagcgtttctagtcttcctggcggcagcacacaggctttatgtatgctttctattcttcctagtgcaagggagcctcctcaagacctgcaaactaatgggccttaagacatttcccactcattcagtaaatacttactaagcatgtcccaagggccaggctctgtgctgggctctgaggccaagcgtatacactccaggatctcaggagacaggaactgtgcaatgaacatccatacgctgcaggcaacagctatcatggactgctaacttcttcccctacctaatgggcagggctggttctcactatgtgagctaacaagtggccccaaaacccttaagaggttctgacgtctaaacaatataatctagaaatctaagccaggtggattggaaagtagctaccagtcagaacttgagattcagagacatagaagctttagtatacacagagagcaaagcaaaaaagggtctgcaactgtagggccaccaggagactggttctggtgctactttcctgactgaccaactctgggcacctgtgcccccctgagccccagttctgtcagctgtacaagatgcaagccagatctttccaactctaacaatctaagcatcagcaacctgaaataaatcacttttctttctgattcagcaaaatatacttcctttagaaatcaggaagagagttaaggaaaacaggttagcaggcagtggtataacaacttaagcccctttgtgtcagggtgttgcatcccacttccttctttaaaaagaactctgccacaaggctacaaactgcctttggctaaacctgcctatctctctaatcctaacacttttaaacccatctgcaataccaagcaagaagcaacaagaccagtggagtctggcccaatttgaatgacccaaccccacatcctgttgcaggattccttccctggctaagcacggaaaaccttttccctgccctttcttctaacttcaagctgctaagcagctgcaaaaaaataaaaaataaaaatagtttggaggagggaagaaaagtcactgtgatgggacagaatgaggctcggccctagtcctggggatctcagcttctggttgcagctcagttgctggctgggtgacctcaagaaatcccttccctgctttgtacctcagctttctcatccgtaaaataagaggttcagactagactaccccagagccatagcccccctttcattgccaacatgatatgattcttcccactactcactaatggacacacaacatggataaaccatggcggagacaatttcccagcaagtgggccccctctaccaggataagaaggggcaggagccctggatcacactgtagcaaaggaataagagtaaggacggacatagaggactggaacaccaagacctggggataaccacgggaggcagggagaaaggcaaggaaggagtcagaaacttcaatattctcagatggagaataggcaaaataatgacaccactgaaaagcgattaggcacattgagttagagtgccagctccaaagtcagattatctggatttgaaccctacctgtgctccttgttagtggtgtggacctcagacaagttacttaacctctctgagtagcacgttccccagctacaacatgtggaaataacagtacatcgcggggccttaaaaggaataaatctagttaataatgcctaatcagttagtgcctcacacatggaagctcattctaagtgtttgcttttattttattaatataatattatctattatactttacaattattattaaaacagataggatccacagattccagtccctgttctctcactagagacctcagaattcaggttccccatttgtaacatgagaggctgaacacaatcagtttttctcaaaggaagatctgtatacatattgctgagggattatatttaagttctctaagaggattttaaacactttgttttcatttcaacagtcatctaaacaaagtctaataaacacatatggattttttaaatgcttactttaaagccaagttctggcacaagatttcaaagcccaagtttatatttgtgtttatgattgtgttggcaccagtataattgtagcaaactcatgaggatggaacaggtgccatcaaattaaggtcatacaagtagaaaaatgggtggagaattcaatcattagcacatgataatatagactggccaaactcaaaatgatcagcatgatagcatttactgccatgcaacttataatttggtttcagttgaacaacagctgcctcaccacatttaaggtattaatttgaatggtattgattttgcaattttggctgcacttaatttgtaaatatgtatgggtcatatagttgtataataacagcctataagaagtttatacctacttttacttcctaatatttaagtaacactataataaaaaaggaaatttagtgaacaaaaggatgctttgacacttttgttcttttacagacagtgcaagcattattctagtttgaggaaaactgaatgaaattctctccaaagtcccttatagccctttgaatctcagaaagatgatcattttgattacagacatgttaagctacattaagacagccaagtggggatactggcttagaatccaggaaaaaaaaataaaggcagaacaggaacaagagacttagaaactaactacagagaaatgcatcctagagatgggatctctaaggaagggtgttcagagatagagagacaaagagctgacgtctgagtttcagggagttcactctgctctacagccctcacatccctctgtggaagagttccattcacctgcgcattaaagatgatctccagattactcaaagcattattggcccatctgggaagtgaatggcttagaaccctctgcagaaataaaacaagtctcagttattatattcctccaggcctgaaggaaagaatccagattgacaccaagatacccagtattgatctctaagagtggggccactaactcacttcacccacagcttccagaaatacaggggcccattaggggcttttggagagccaggtggctcccagggctgcagcaaaaggaaaaagtggggtgctcaggggcgattcggagccaggtcctagggatcagaactcatgcctgggcagtagcacaaaccaaagctactatttctacctggctgcaaatctgccctctatgataagccacatgccatatccggaccacacagtcctgtgtccataagagccagattccatcaatccctgtgtgaaaaccaacacagcttccttccctccctccctcctccaatccccaactcaaaaccacaaagaaaaaatgagagaaccccccgctgctgaaaaacccaagcttactgtttgtcttcttctgaaagtgaggttcttccacagcagcaacctcagctgaggccaacaagccatgttccctcagccagcacccccagcgtgtggctcgggagccctggaaggcagcggccagagctcacagcagggacgccgtggctggtcattaactgaaagataaagcaggaggggaaacagccatcagttattgctgcaaagccatacaccaatgaggactgctaatccagccctctcagctgagacctccaacacacagctctgcatcatgactgcttctcaatggatcatgagtcaccagctcccagcctctgggttcacccacaaagagggactcgggaggtgttccgacagcaggctaggagctacgtgttatggtcctaatcattttagttctatagatgttatcatctgggaatgaagaatgcatttctgaaaatagacctctctcaggtggccaaaaacactgaggatggaaatggcatactggaatcccagagacctacctctcttttctaagaaaatgcctccccttacatacaaagtcagcagcatttgtaaattttgcctcaagcctggagtgacttatactattccctgaacttccttacatactaattttcagtgggttatacaactgagtccttcaaatgataaaaagcaccatcggccaggcgtggtggctcaagcctataatcccagcactttgggaggccgaggcaggcggatcacgaggtcaagaaatcgagaccatcctagccaatacggtgaaaccccgtctctactaaaaatacaaaaattagctgggcatggtggcaggcacctgtagtcccagctacttgggaggctgaggcaggagaatcgctgaacctggcaggcggaggtgcagtgagccaagattgtgccactacactccagcatggcgacagagcgagactctgtctcaaaaaaaaaaaaaaaaagcaccatcaataaagcagtttcctaatctggaaaaccacaacgtgccttagatgagtgtgagtaaacaccaagaaaatgctaccgacacctggctctcaggtaatgaggacaaccctagcgctgtgtctctggaaagaaaacagcatcccatggagaaacaagtctgctatggcaggctcagggcatcaactgtgaaaccgacaaacaagctcccatggtcagcacatatgcacacttctggccttgttccacctgcacctgaacacaccgcccccctactccgttgggtgtcacaggtgcctccttggaggactgtttgccatgctagggcaagaaggtcttctcgtgaacaagggatactacattctgtgtatcccagccacccatccagcagttacccttatttaatgctggaatagtcccaagtagttatattaaagttaaagctggggagggggcagaagatgaaaaatggaagggaggacacacaggtgaaaattcggccctgctggcacttggtagccatgaactctcctagctgtgcttatgaaatggctcagtgaatcactgtggcctctagaggagtaggggcaagggtagggtgggacactgggcatgaggaacaaggagcagaaggaactaagaatgcagtagcgaggtatggatacaaaaccaagcgctagactagaaatctgtgagtccaaatgagatctccatgccaaggtcagtctctagtagaacaatacccttttatctaccacccaacaaggacttggattaaaacttctagaaaagtcaagagattggaggaaattgcagtgtctgagaagaaaagacagcctaccactatgtattccaattcattcattgacagtccaataaatcaagaaattctctgaaatagtcaagccttaggacctatttcttttccttaccatttgctcagcaaacttctagaaggacacaggcctccaaagtttcttactccaaaaagaggaagagttaaaccagcactgcatcagtttgttcaaagatgacaactggcagcacagcactggcaaccagagcagcattgtgagacacatgcttgtcatcccaaattgttttctaagtggctcaggacagagcttgcattccagagacactgaaataaataattagctagatttttctcatacagaagctgctctccaggaatcagttcgttgatttagaagctacatgaatctcttgaaatccccaaggtaacaatgaggaggggacaattaaaaaaggaaaactatcagaaagagcccaggcatgaattagccccggcttcccaactatgtgcccctggccaaggctttatgctctctaagcatcaatttcctcatggtaaaataaggatgacaatacttaccttgtatggtgttcaactgtgttctactgtggattcaacgagataatataaataatttcccaacacagtacatggcttaatttaagtgccaaagcaatgtgagttcccttctccccatttatctttcttcattccaacaatatcctctagctgagaaatggttatatcctgtccaaacaggacgttccattatttctagcaaatccattgtgggtttctggaaagataggaggggcaaagcagtaaggatgaaatcttaatagcctagtgttgcagtacccagagccaaacccaaatatagaatatcacctcccctaaaccctgagtggaaaagctcaaaggaagagaagacacacctctacacaacgttcatgagaagaagggaaggatgagttttcttggacagcattttcttggaagtaaagtgtctgggtttcaagaaaaaggttctgactccaaggactctccaggaagcacatggagaaggttgctaagaagtagcatagagccacagtagaaagttctaccgtggctttgctgggcacacttaggcaagcttcctgctccaattcctcccacccaccttggcactgacctggcctcctgcacaatttgctcccccaactcagaacacaatgatcaatactgggagcaattctgtcctaagaggagagtttggcaatgcccggccccttctgctcaggtaactgaagccaaagggacatttccacatcagttttccaagttagtgaacaaacaaaccaaaatcaaaaaaaaaaaaaaaaaagatataaaagagacagtactatgtactagatttctcaatgtttcaaatgcagtacactcacttctgccctcatacacatttccagttactggctggaaaggatcccacttcacagtcatcccagtcaataggccactctgatcctgctcctagatgaccgcaactgccacctcactggtctcccaaccatttgtcacagagcacccaaagttactcagctagaccaaatatctgaacatgcctctccccgacttaaaaccttttgccagctcctcagcacctgaacatagagtccagtgctcaccaaggtctacctggcctcccttctgtgactccagcctactctcttgccactccccacctgctaagcaatgccctggagatgtgtatacaggctcagaatatgctgcacgctctcctaccactgggacttcactggtgagttctcttgtcctaagacactttttcaagcactgctagcctggctaatgcctaggtctcaaacttaggtctccacttcttcaatgtcctttcctgatatcctcccctgcaactgacacgtgggttcagagcccttcctacgtgctccctaggaagacttggctgggaaagaggatttctaccttctgagtcagagcagagaccatttctgtttccttcatccctgttttccttagtatgcaaaagggtcctggcttgtcgtaagcacttggggatgtctgcttaattaattaagagacggataggagaaatagggtgtcagaattcaagggtggcagcactcctggacctgtggtaactcatttctcaagcctgattaaatgatttgggcaaattatccccaaagagggagctctgtgttcagcagcttctaccatatgcttgaaagtcacaaaggactgctgagcttcccaggtgactcctgggacatcctgaaaaacgtaatagaatctaagtctgtttcccataactgccagctttagctaaggactgggcagcctcccaaggccagcagggccatgcagtcgacttcccgcccgtcctcaccctcaagcccgaggcgtacgctctctgggtctcatcagtcacccaagtggatcactccttgccaaaatgtgacaatctccacacctcagccttgtttcatacagtttgggcatggcagaagtgactgctggaaacctttggccaattttttaaggaaattttaactgcaaatgccactgatattttgaagttattaatatctacagaatacaacagactgctaaattaaaaccttcccaaataagcagaaacactcatcattagctgcagagaaatgcaaattaaaaccacaatgagatatcattacatacccactaaattaaatattaaaagtgctagcatgtgtatggagacactgggactcaatacactgtggaattgtaaaatggaagagccactttggaaaatagtttgacagtttctgctaaggttatacagtactattatatgacccagtcatcccatcctaggtatttgtgaatatttatagaagccttatacagaatagccaaaaactggaaacaattagttgtcgaaaagaccatcaactggtgaataaataaaactggggctgggcacagtggctcatgcctgtaatcctagcactttgggagccagaggtgggcggatcacctgaggtcaagagtttgagatcagcctggccaacatggtgaaaccccatctctactaaaaatataaaaattagttgggcgtggcggtgggtgcctgtaatcccagctactcaggaggcaggagaattgcttgaacctgggaggcggaggttgcagtgagctgagatcgcgctaccgcactccagcctgggtgacagagtgagacacctcctcataaataaatatataaataaaactgggacacttactcagccataaaaaggaataagctactgttacatgcgacaacctggatgaatcccaaaagcctaatgctaagaaaaataagccagacacaaaaaactacatactgcatgattccatttatatgacattctggaaaaggtgaaatgaaggggacagaaatcactgcagtggtgaccagtggtcatgggtggaggggacgacagactgaaaaggagcatggcagtggtagatacacatgtgtatccatttgtcaaaactcatcatacttttgtaaaggggaagtcttactgtggtaaattacacatcaataaatctgaaccaaataaactgccttctattatcataattaacatacctcacaagtcataacttggaagacctaagaactggatagtgtaaagcctgattattgtgtgatcgccttggaagaggaatagtagataaatattcattaccacttataaattccacaaacaactgcagccttaactctgcaaggtgcccatgagccacaacaaatatttatcgagtgcctatcacatgccaggtgtgttccataccttagagattcagtggtgaacaacagaagcaaagttccttcattcatggggctcctattctaccagggatgggaaacagacaaataatagtgggttgttcaaacagtgggtggtggtggtaggattgacgaagaaaaataaagcagagtaaggggacagagagtaacggggtggaagttattcctttctgatgaagcatctttaggacaatgaactgagagagtggaccatatgctacccacaaaggggtggcttaaatgacagctgggattataaaattacttttacttttccctaaaccaaaacctggaataccagacagcagacagattcagtgatgctggcaaaagaaatacacacacacacacacacacacacacacacacacacacacacacacattcacaggaagctggctgtgaagggggaaatgatgaccctagttagcacctggcacgtgttctcccacctcttcctcaccaaaacattgtgcccttttgaacttgacatgcacatttccaggagagatgagagatgagaattataaagaagaagaaaaggggagagaggatgacactaaaaagacaagataggaggatttttccccatttggcatagccaaaagaaaaacaggaactccttcccgtgactgccctctactcttctacagcactaaatctgtctatggaaacacagtgaggaaagaaagtgcatgtatctgtacagctaccagaagctgtttgcttgtgcagtaacaaatgggctggctggtctttttccttcccgcaagaacactgccaacacatgagctttagtgctgggctcctatcgaagggtgacagtcagccctcatgcctgagccagggcaggttccagaagagggaagtctccaagcagggatcatacaagtgtcaacatctcactgggacagagaaattggcccctctgggtggaagaggagaggcttccacaaagtcatgctccatttgactgtcgtattagtagataaaatctcttggaatgttgaagactcattcccactacacccctgctgcaatcttatagacagagaagctgaggcctcccccaaagcaagtgacttgcctagcattagagctggtttctcaagaaataactttttcaacaactcttatatgccccttcccacttagctatttctcctatgattttgtttgttgttctgaatgcatttctcagagttctatccaaatagttcacatacccaaaatgtacagatagcaactaattctcctctttcaaaaacagtgattatatgacagctatttcattaaaccttaaacaaacaagagagtatgtgtgtgtgtgtatgtgcgtgtattccactttgttcaacaaacttccaaaaagttaccagaagtgagatggaagttgaaatttccaacaacagctatcaatatctctcttttttattactttattttattttttagatgtaatctcactctggtgcccaggttggagtgcagtggtgtgatctcagctcactgcaacctctgcctcccaggttcaagtgattctcctgcctcagcctccggagtagctgggattacaggtgcccaccaccaagcccagctaacttttttgtatttttaatagagacagggtttcaacatgttggccaggctggtttcaaactcttgacctcaagtgatctacctgcctcagcctcccaaagtaatgggattgcaagtgtgagctaccatgcccggcctcagtatctctcttgatgaggttgcttctagatgtctttttcgtaattgaggtataatagacaaataaaaatgttatatatttacagtgttctagatgtcttatatcaaaaacagcttgccagtaaactacaaagcaggaggtggatttaactacatcagatatgaactgaaaatacattggtgccaaagctctgattgcctattcatgagatgttgacacaaaagcaagaatcacagatatgactcatgtgcctcatctccagagagatgcacagggtcctataatattaggacatgaaacttctaagcccaacagaacatgcttgctttggaaaaggtctgttctctaattgcctctctgatcatgtgtctttggatcggtagccacgttcagggacaagcctaacaaggttactgaaggccaagacacctggaaagaacaggttcactgcacccatgattaaagacagacagatcgtggctgctgtgggggtgggaggggatattgagagtcatcctgcaatttctcccaggctgacccatcagcttaattgagcctgaagctaatctgactgcctcagtttaacttttctggcctccagatgctactgggccctctatccttaagggtatccttgctaggacagccttaaattatacctcctcacactcctgaaacattccataaaccacagttccagggaaactaccttgagttagggggccttgcagaagggtcatgggctggtactcccccctgaaactgtgttcctatttttaaaggcaacattttaatagtcaaatttgagaagccaaaaggggtaagaaatcctccaaggtaaaagtcaaggatgaaatgaagttatccaatcattccagaggaattctatcattctataagaggttctgctatcacactgtccgtttaaaaatatatagatccagtgaattttattaattccaataatctgtaacttgggtgcagtttttaaagtaccaaatgcatcacacttacttgattgttagttacaataagataataggtaactgtacttccttctttcacttgaatacacatccaatttcctagacaaaattattgctaatagctaattttcaaaataagggctatgaatttgtaaaaactgaaacaagaaatctatgaatattgtacaaatctataactagcttttgagaagcataattcttcatgttgtcaacaatataattttacaggagatcctgaccgggtgtggcggctcatgcctgtaatcctaacaccttgggaggctgaggcagcaggatcgcttgagcccaggagtttgaggctgcagtgagttatgatcatgccaccatactccaacctgggctacagtgcaagaccctgtctcaaaaataaacaaacaaataaataaggagatcctaaaggtttaactccatctatatcatgtcactgatacttggacaaccaaagatcctatttatcaccctcaacattcccgttgccaccagctaaatggtctcagggcttctaaacctcacaagagccaggatttctgaaagcagatctgtcctgtaccccaagtccttgtttcatcactatagaactacgaagaaactctaacaaaatgttagagatagcctctcttcccctgctgatttccactaagcaaacaccaagcaaccttcaaaggaagacttcagcaaacaataccactatttgccttttccctggtcggggggtatgtagcacatagaaaaaaagaatctttcctctagaaaagaaatcaacctttcaacattctatgtcatagaaaaaaaatcaatttttttcagtcacaatcataacaccagaataaaagggatctgaagggaagggattagtgaattcataaacaccctgagctacagaaacacaagcaggcaagcctctatcagcaaccctttatttgcagaaaaacttggctggataatgttccctgctgttataggacggttttccaagagaattttgggataaatggtttagtgaccatatcaccaaagatcactttgtttggattacatctctgaagaatcagtgtcttcagatgttcaaccttctcccaacctgaaggatttatatttatgaaagtgctcaaagcatttggtggggcagacaaacccaaatcttagtcactgtctttctttcttttcctttgggtctattctaccatgcagaaaactccccaaatccttaactcctttgttgtcttgagttaattgtttcagcaggaagaaaggaggttttagagtcagagaaagctgggtttgaatcctgactctgctactcaccagctctggaaccctagggactctgagcccctgtatcttctccaaaaaatagaactgataatgtatgtaaaacatttatccagttcctggaacaaagtaagtgtacagtagctattaccatgattaattctggcaatttcacagtgaagtattcatcaagggtgggacacagagtgggtggtttattaaaggaatctcttttctgtattctttgtccacagaaagggcctttccagagcaaactggagcgctctccagtacccagtgcattggtagaggtgaaagcattatacggtatcctgttgccacttctgaccattgttttactataaaaccccctcttgggggtcctcaccactcacttatactattttctctacattctcacagaggttgcacctatcctccatagcacactgccacctccctacaagtttttattttattttatttatttatctatttatttatttagatggagtctggctctgtcgcccaggctggagtgcagtggcgcgatctcggctcactgcaagctccgcctcccggcttcacgccattctcctgcctcagcctcccgagtagctgggactaccgacagccgcctgccaacacgcccggctaattttttgtatttttagtagagacggggtttcgccgtgttagccaggatggtctcgatctcctgacctcgtgatccacccgcctcagcctcccaaagtgctgggattacaggcgtgagccaccgcacccggccccctacaagtttttggcacctgactcagttttcctgtccatcccatttcctccagcctctatgtccattagaaatctctattagaaatctgagccttggccagacgcagtggctcatgcctgtaatccctgcactttgggaggctgaggcaggtgatcacctgaggtcagaagttcgagaccagcctggtcaacatgataaaaccccatctccactaaaaatacaaaaaagtagctgggcatggtagtgggtgcctgtaatctcagctactcaggaggctgagccaggaaaccatcaagtgagaccatcaagtctcacttgaacccgggaggcagaggttgcagtgagccgagatcatgccattgaattccagcctggacaacaagagtgaaactccatcttaaaaaaaaaaaaaaagagagaaatctgagccttataattcctccatcttttcagctctacctacaatcttctctagtgtactaactcatcagtgatccctgataaattaagcaatgtgcaacaagctactgtgtctcaccatcttcctactctccactacactgaacccacaatgacgcagcgctccacaatcacatgtagaatggaagtaaaacctcagcgataagaaaagatagttaaagcagattcactacagtaacaaaccagtcaagaaatgtcactgaaagtaaaggtttgtgtgacaaaatttccagctgtgttctaagaaacataagttcaagcaggagtgcatttaatctgatttttcctcaaagcctctctaatttgtagggaagcacattcattttcattaacttcatgtgagctagagagaatctgtgattgaggctctagaacccctggtaaacatgccatcaagcaagggcaccttccccggaggttcaacctagagtataagattgtcagcactggtaaagagccttgaactctaaacccatagataggctcaagtcaggaactcagggagcctataaacacctggatacaattttgccaccttaacacttttattccctttacttgcgccaaactgagttatccaatctccaggctcttgtccagttctagttcatacagtatcggcagccttctccagaacgtcctttcaccagccagctcttgagacagtcatatgtcatgtgtgcaagacacttctatttctgcagcccggcgagggccagctaactcggttagtgacaatttaatcaaagttccagggcaagcacagagacacagagtctaagtcttgccctccaaaacttacaagcaaactccttctttagaataaccaaaacaaaccctctcgctggctgcctcactaaattaagagaagaaaggggaataagatcacaagtttaaatccacttacttgtgattctgaaaaacaaaaacttaagggtgtttttctttaaatattgactacatgaactctattatatgaggtctgagaggatcctacaaaaggatctgtattattccaatattatcaagattctgagtgttccttatagaaaaaactactgttattaagattttcacaaatcaaacattctgtgtgccaaagaacaaagtgggaaaaatggaacaaaagtgggaataattcccaaaaatggaattattgggtttcatttttggtagcctccttctgtcaactgtagttttgaaaaattcacacaatccaatcccccaagcaacaacgcgctaagtgtttacatcaggtgagagctggtgttggtcacatatgctatgaactagaattggacaatgtcccaaaacggagtgccatctggggtcagagtgccatgcccttctctgcagactccagggacatatccactctgcttaatggaagccactggaaccaagtgtcagacagccctctatttgctccacagagaagaaagccatgctctgatcatgtgaaatgtgactggaattgtaaactgaaaaatggcactaattccactaaatttgcaaatcctgcaacaagactgacaacttaataaacaatacttgaccaaaggctttctttctcgtgaactcaaggttttcactataattaacacaatcattaaagtaaaaaaaaaataaaaataaaaaccctgccttgattcacagttaattttaagcagccaacatcaacatcgggtttcaggcttttgcataaagaaacagcctttaggaaaccctcaacattcaggattttgttctgattcaaacttacaaagaacaatttttagttgagagaaacaaaaaattccagttgaaagacgccttaagattcaaattggaccaacagacaggagaaataaatgaggccagtccaatatttaacatttcagtgtccattttaagctgaaaggaacagacatctacagacacaatttcttctttctctcctataaagggcactgtaatagttatcctaaattctggtatagtatgaagaagcctggattaaagaggcaagagactaagattttaatttgcagttaatggcagctggagaataaatttagcacgccattctaccactgtgggtaatggaacagaaaacaagtccttttttttgtttcttgacacagagtttcgctctgtcacccaggctggagggcagtggcacgatctgggctcactgcaacttcagcctcctgggttcaagcaattctcctgcctccacctcccaaagtgctgtgattacaggtgtgagccaccgtgcccagccagaaaatatgtctttttgatgaagaagctgaagtggatgaccttctgagtctaagaaaactgtttgggacttgggtattcagtagccatggaatatacatcccaaagagcagaagaaaccgtaacactagaccccaacatcaaaaatatgttgctattttctcccacattgctggtaggggtgcaaactgggacactttggcaacttacattaaaatgctatgagagaacaggggaagcattccttaaaagttctaggaaaggtgttatggaggaggtagcatgagaaattcagccaagtgggaaaagcacaaacctgggagtcagagagacaagagtttgaatccctggctctgccattagccaaatatggaaccatgaacaagttatttaacttctcctcggctcaggtgcatcatctgaaatatggggctaatataataataggcaagctcagtatttccccaaatgtgggagagttacacaggatgaatttaagtgatattcagaggattttaggagatgaacaagcacagtattaaacattgaaccacatcatgagaaaatatggttcttttcagcacttcttcagcctatatataacattcttagtacattaaggagtaagcggccgggtgcggcggctcacacctgtgattctagcactttgggaggccgaggtgggtggatcacctgaggtcaggagttggagaccagcctggccaacatgacgaaccccatctctgctaaaaatacaaaaattagccgggtgtggtggcatgcacctgtaatcccagctactagggaggctgaggcaggagaatcgcttgaacccaggaggaagaggttgcagtgagccgaggtggtgccactgcactccagcctgggcaacagagcaagactcgtctcaaaaaaaaaaaggagtaagcttttgtttagtcttctttttgacacctctttaatgcttgctaattcccttttcaacaaagtaagagaagtctcattgtcagctggggcctttgggaaccaatagtttatcttatacatagactgtgagaaaaataatttgtcttcatcctaattatttttaaaattacctttcatttatgataactcatattggttttccaattacaggtcaaatataaagttattttaaaatatattgatgattacaaaaatttgagtcaacttgagtgggctgaaatgctacctatctcagagttccagtgaaaattaaatgagatcatatataagaagaactagcccatgctgtgttccatcacccacggtctggttgatgggtaaaatttcagtaggtgaggaatatgagcagaagatcaagtgtgaaccaaggcaaatacatgagatggacatgagattccagaacaatgaggagccaaacaatgccaggaaggggttcttaaagtagaagatgaaaacctgtagagagagactcatttaacaggtaccaaaccatactatatgttaatcagtctggtgagaaaaccagctatagttccttcgagcatgtgtcttataatccaggacaaaactatcaaagtgggtcacagtcttatttcaaagagccttgaatgccaagcagaaagagatcattaatggtggcagattcttaaaagtcttttgacctctgtccagcacctagtactttccacagtacatggtgtttaacaaacatttgctgaacaaataaatttgtttaatagcactataggtgtattagtgcatttaattttcaaatataaatatgtattgttgttgttaatatcatatcttcttcttccttctctctcacagtaccagacaacagcctaaccccaactaaggtaaactctgccaccaaacatgcctgggaatggagaagggtctgcaggtcagtgtaagctcatcagtctgggccttcactttctccctgcctttccaaggaaagctgctgcttgcatcagtgttgcctttatgtcaaagtgtatcacctaaataccagatccaacagatttcaagccaccaccctccaaagacttgcttcttcaagaaaacaagcgtggtttgactcttgtgaaaaacaattactcccaacctggcatcctacaagaattttgcaaagcaagggtgaacagggatatgacaaccaaacatcttcctagcagctccttccccctccctgctcctggccagaaacctcttcttccttttactccttcttctttccacttctaatttgttatgatctctcaaacaacaaatttggtacagtgctttagaaagctttgtgtcttaccgacctacccccagtgagggtcttctgagatacttcaaactatcctcatgaggtatagtccaattctcctcctaggatgggtactagcatgctattcttgaaggatgaatgagcctgaagagttggttatggtttcctttcatcacctattggcttaacaggagtccattataagaagtaaaacttaggccgggcactgtggctcacatctgtaatcccagcactctgggaagccaaggtgggcagatcacaaggtcaggagttaaagaccagcctagccaccatagtaaaaccccgtctctattaaaaaaatacaaaaattagccggacatggtggcatacgcctgtagtcccagctactcaggaggttgaggcaggagaactgcttgaatctgggaggcggaagttgcagtgagccgagattgcgccactgcactccagcctgggcaacataacgagactccatctcaaaaaaaaaagcaaaacctacacccaaaatgatgtccgagatggagagtccaattttattttagagagattttccaaatggtgagtcagaagcaagaacagtatctcactaaatcatgtttactcaactgaaacttattgaattaaaccaactcctccttcctttgcatttcagatgagaaccccttctggttctatgattcaaatcttcattcactcaaagcaggtaaataggaaatttcaacagcttcctctcctccctctcattcctttcttctgtcatcgatctgatcaggaatgctctgaggcattccctggttattttttctttacctctcaaaatccacatggtatgttacactaatgcccagcatgttcctcagatctctagatggctctaattaaaggaccaccccttcttctgaatacagacctggggttagaggacataagagcttgaagggctctttaaaagtcaagtagtatcattttacagaccaacaacctaaaaaacagaaaagtaaaatgacttgtccaaggtcacatggcttaatggatttgtgggcattcatgaacaccctgtaattacacataaaatttggattatatgagcccatgtgtattttttctgaagagaaaatccgtatctttcttcaaagaagtcaacaatctcttccccaaaatatagtaaccactgacaattatatgcatatttgaaaaaaagtttaactaaaatttaatgttccaagtctgaatagtaatatgaattggtgatctagaataagagtggaacctaatttaataactgtcattgttatcatctttttttcttttcatgtctgggatatcaatgcaagtaacatgggataaagacaatttgatgtggaagtaaactataaagcaagatttttgttttgttttgttttgtttttttgagatggagtctcgctctgtgcagtggcaccatctcggctcactgcaatctctgcctcctgggttcaagcgattcttctgcctaagcctcctgagtagctgggattacaggcttgcaccaccacgcccagctaatttttgtatttttagtagagacggggtttcaccatgctggtcaggctggtctcgaactcctgacctcatgatccgcccaccttggcctcccaaagtgctggaattataggcagaagccatcgcgcccggcctaaagcaagcttttaaaatcactgaaaacactcgtatgaataaatttcactataggccaagcattatattatacggttcacattatacacaaacacaaatacctattttacagatgatgaaactgaggcaaagagtgatcagcaacttgcctaatgtcagatatccattagtaataaccagaattccaatctacattaatttgactctgatatccatgttctttttcaccaatatttgcatctatactccaagatgtcctaatactaatattctatttacttatttagaagaactaaatcaactctctaaggtagcttcaaggaagtctttcataaatggttcaactactaaaaagttcttcctgggaaatatcataaactaaataccagctatcacaaaatatctggactttaagactaaccagataaaatgttttgacttccaaatgcttcttggaagttggatttggcagagaaaacaccggggaattttaaacaaacaccccccaagaaaagactttatagaagaatagatccaatgcatatgaagttactgttttttaaaaaagtgtttaaatctctaaattacttagtgagtcatgtcactcttattaacaaaaataaattaatatacaactcaaagtacttgaatatggaatgccacagactagagcattttcttaaatcacagctgcctcagaaacggaaatgaaactgagcgaaactgaaatgtttgttctacaaaaagtaacctggcctaaataacttaagtatgcactaaaatttctcagtctaacataaacctagccttaactacagttgtttctcatataactctatttctaatgcttttctgtgattaccctgttatcttaagtagtcttttagaagacaggaagcaaacatgagcttcccattctccttgttggacttattcaagtcagcatttattaaattttttccatattaagtgggatgaattaaggccaggggagaatgaatcaaagaccttcctctagagaagcatacactcaagaggaagacaaataaatgttaactgtaattaaaaaacagaattaaatacatgatacaaagagtgctgtaatccaagtctaatggaagtaaagagaaggggatcttactttcaacttagtgatgggaaggagtggatccagaagagcttcatgaggagggaagcatttaaatcgggtcttaaaggaggtttgcaaaagctaaagggttttgtaccaactttgttttcaacatgggaaagacaggatttcaaactttattttgttttaggaaccaaatccagtgctcctccattgttggaataaatgctctttgcctgaatgctatttgtggtcttcgtagaatggagagtaactgaaggccccaccggaaatcaattttatgtaagcttttcattctctggcctcaagtatttctaaaatgtacctttctatgcaggctacttattcaggcaactattttcaggtgaagatactcaaatgaaaatagagaatcccttttggccttttgctaatatttcatttgtcaaaactttgatagtctgacaaagtctttaccatgagattggtaaactcacggaagccaaactgtctgggatgcgacttcagctccactacttacgaactccataataatgtacctagcctgcctatacctcagtttcccatctataaagacaataaaagcacctatttcactcatgagaatgaactgagttattacacggaaaacttaaaaacatatccaacataccataaatcaacagtaaatgtaactatttttaccaagaggtgtcttcaaagagtttatttctaattcattacaccaattaataagaaaggcactttctcatcctatttcacttttacaaggcagacattttttttcaagacggagtctcactctgtcgcccaggttggagtaaagtggcacgatctcgactcagtgcaacctccgcctcccaggttcaagcaattcttctacttcagcctcccaatcccagtagctgggattacaagcacccaccaccacgcccagctaatttttgtattgttagtagagacggggtttcaccatatttgccaggctggtcttgaactcctgacctcaagtgatcctcctgctttggcctcccaaagtgctgggaatacaacaatgagccagtgcacccagccaacaaggcagactttgaaactgtgtttatcttccaaaaatacgtatatcttaagaaaaaactaaatttgatttctaaacagtaacagcagtaacagagaaatagcttatttcaaaaggtccacaacttcatcaaggacaggacaagcaagaatcatattgtattataacaaatttttacaattcaccaaagttaggttttacaactaaactaacagttcacttctctttttcctttgtttcttaggcccttacagcctaatactctatcattccattttctatagatcacataggaaaacattttgagatcacacagctattcgcaaacatctgactgaagcaatagtatagttttcattatgaaccaagtaaaaaattgagttgagtaaattttattctattctttccaggatgttgcaatccctacgcaaccaaggtttcaagttaaagagaatttggctgacccactcacagcaacaaggaaaatatgatacaggctgtagattctgataaggattatagcagatgaatgtagagaatgtggtgatcatccttgaaaagctccctggttgcagcagctgaaatgttagtgctggagttaaagaactctggctgggttcaagtcttagctctgcctcttgcaaggtatatagccagagaaaaattagcttctcatttacttaatcttgtaaactagggacaataaatggttttgttgtgaaaattcaattagcatttgatgacctgcacagtggcttatgcctgtaatcccagcactttgggaggctgatgtgggaggatcacttgagcccaggagttcaagaccagtctgagcaagatagtgagaccttgtctttacaaaaaattgtaaaaatttagccaggagcagtggtgcgtgcctgtggccccagctccttaagaggctgatgtatgaggatcacgtgagcgcaggaggctgaggttgcagtgagccttgtctgtgcagctgcactccaccctgtgcaacagagcaagaccctatctcaaaataaatacaatgaataaacacgtgaaaaacatttcaaacagtacttgccacacagtgctatataagtgtctattcaacactgcaataactttggccattcatggttgtatccacatgcagatacgaagatggttgcattttttggagtaggccttctctcagcataaacaaaacaagtgttcagaatgatcttttaacatttgatgctagagtaaatgaccataacaactactataatggtattatttatttaatatctggatacttaaaaaaatgtatttgaggccaggtgtggtggctcatgcctgtaatcccagcactttgggaggctgaggctggcagatcacttgaggtcaggagcttgagaccagcctggccaacatggtgaaaccctgtccctactaaaaacacaaaaactagccgggtgtggtggcacgcacctgtaatcccagctactcaggaggttgaggcaggagaatcacctgaacctgagaggcggaagttgcagtgagccaagatcattctactgcgctccagcctaggcaaaagagcaagactccatctcagaaaaaaaaaaaaaagaaaaagtatttggttttaaaagtattttagaaatgcaaaaaccacatgcattttgatattttctagacatctagatatcttcataattagaagagtctatctaaggtaatgttcacttattctagcagctaaaaatgaaaacagtgaagaccttaatttgtagccactacatatatagcttaagtatcccggcttacgggagagaagatccctttaaaaaaaaaatttaaatggaaaaatatcccaaccaactcctctccaaaaaggtaagtactacagaagataataaaaagctaagtcactgaacttcttcagtttcattcatttttttatgtttacaatgggacttccttgagcagaaggaaccaatccttgaaaacaatcaattcctgatcactcttttccaatcctgcactaatgcactgtctcacacaaaccgaaaatatgttctaagtcaaaatgtgtccaggggtcgggcgcggtgcctcacgcctgtaatcccagcactttgggaggccgaggcgggtggatcaagaggtcaggaaatcgagaccatcctggccaacatggtgaaactctgtctctactgaaaatgcaaaaactagccaggcatggtggcgtgcgcctatagtcccagctactcaggaggctgaggcaggagaatctcttgaacccaggaggtggaggttgcagtgagccatatcgtgccactgcactccagcctgggaaacagagcgagactgcatctcaaaaaaaaaaaaaatgtgcccagggtccattataggcctgcactcgtagaaatacgagggttgagatttcaaatgctcatctgcaggggagacaacatatcacacgtgtccaggttacagtcagatatgtcattctggaacactatgcgggtgctcaaatacagactcctaaattgctctgacaacagtagcaattctagtcccttaaatggcttgtagtcatcgtgaaggctgaagacccacttccccggtccttctgattgtaaaccaatgttttcctaaaattccctagcattaattattttaatggtttgtggaattatttaatggtttgtggaagcacttgggaaacaggctgacaatggaaactttgtatttgaaaaatattgtaatatctgtagaggttctactcaggaatactttccatgcttccatactttctctgatttaggagaaagtttctcaagagaatgatactctcaacagaaacggaaagtttctcaacagaaagcctccattatttttgtggtaggtatgagaagaataggttgaaataaaaggggagatgaaaacttaaggactttaagttttgtttgaaaagaagatcataatttaagtctgggttctaaactacggccgttaaaaaaaaaagaaaaaaaaatcaagaaaattccactctttaacttgggggaaatttttgtgaggttctcttcgtgggaagcagggattcggccatggagggcaagtgacttgctgatttcagtacccagaaggtttttttaaatatgaaatttgtccactatgagatgaatgtgtatatactacccattctcttcttgaagtgtcaatgaaaagtcggattttaaaagctaatggtatcagtgctgcaaaggcaggccaattactgccagtgccagacaacttttttctttgtttatttttaatcttatttctttgcttctttttgataaaagatatacctaaagaggcacctacacataaccctggcaccgtccgccgccccaagaaccttcctgctttaccaatggcctgggagttggcaaacacgctaacaaaaaaaaaaaccaaaaaaacaaaaaaaaaaaaacaaaacgggctttcgcctcaacctcatagttcctccccgtctgcaaccaccggtcttcaccggattcacagtcggaaccgcgagcaaagacacctagtagagccggccgattcctaggtcctccggccaggaggcgctgcgggccagtctccgggggccaccgcagcccgcgcgcccagcacccccaccctcacggcagagcccagcccagccccgcggcggagctccgagttctgcgccgcccgccggggttactcccggtcattccacggcaccacctcggcccagcttccccatctgcgcccaggcagaagctgccccgagagaccagcagcaacggtctggaagatggggctgcagggaacgtgggagagggaggattgggcaccccacctccgggtctccgcaggctctcctaagtcttgtttttaaaagaaacaaaactcggccgcgcgcggtggctcacgcctataatcccagcacttggggaggccgaggccggtggatcacctgaggtcgagggttcgagaccagcctggccaacaagttgaaaccccgtctctactaaaaatacaaaaattagctggatgtggtgacgcgcctgtaatcccagctactcaggaggctgaggcaggagaatcgcttgaacccgggaggcggaggttgcagtgagcggagatcgttccattgcactccagcctgggcgacagaccgagacttaaaggaaagaaaaaaaagaaaaagaaaaggaaacaaaactcgtccgcgctctgcgccagggacaccagctcagctgagcgcacggagactgtaggcaggacctccctacccctcaggtcaaacaaagacccaaggcctctagtgagcaatagcaccacggaccgtttgggacacctccaactcgagttcccggattcacagtccgggactgtgccgctccagtcccggggagcatatagccaattcccaggtcagaacagaccagcttcttaagaaccgagtgaagactcagtgctggcatttgtctccgtaggtactggccgacctgcaaccagaagggtttctagccagctcagggccctccgaacaaagcagcgctcggtgccggacctgcagctctccccacccggcagcagcgccctcagcacgcccgggaacccccgacccctctgagcccggggtactgcgcccgggtctccacgcccagagatgctccccggtctccaccgtcgggcaagccccaagcgcagcagcgcagagtcctggggtcaccagagctcgtactaggacatcgtctccccatttaacaccgcctccggtcccatctgagttgcaagtggtggggatgtggggctccggatcaaagtccccgaaaccgagcacttcccgaagcctccttggcctcgaaacaaaacaataacgcccaagtaagtcactggagagcctcttacctgttttccacttttgtgtttgcgtctctttctcctaccccttgacaagccttccggagaaggggagaaaacagaaccggggaaaaaacaaggagcaaagcgccctgagaaccggctctgttggtgcgcggagctccccgccctgccctgccgcagcccgggagagaagggtcggctcggctctgcgggtcccggccccactcactctcgctcgcaattacggggtttttgccgggactagttccttttatagattcggctgcaccgagcgcagaggttactatcggtcaaagcctgtgctctccctcctccccgccccgttcccggcctctgtttatgtagttcagtcactcagcagaaagcacgtggagccggggcccgccccttaaacgggcgacgttcagccgcccacgacacatctagggagttggggggaggtgggtggggtgggggtggagggtacagcaggtgtcttagggtccgcggtctgcgtccccttcccccgcccgggcccgccggcctaagacgcgcgggaagcgctgggctcggggctgcgccgcagactctctagtccacgttcccggcagccaagggcaccagtggaatttgcttcctctaaatcctgctttccgcaatttttttttcctttgttagtttcctcagccggagggagggattgggggagagagagctctaggctgaatctccctcaggacgccaatcattttgtcttgtcttttgtttcctttcaaaggcctaggctggggtgaggggaaggcggacagtcctctgggtaatgggctgcttttgttttccccccacaaacctggactttgatttttgataggcgacctactgccttggagattcccagcctgagctccccaggtccctcagaggacccgagaggaacatcttactgcttctcttcataaattgagaggaaggaggccacaaaaacaaaaaaagaaacaaacaaacaaaaacacagaacaatatggaccagcccccttttaatttcattatattgatcagcctccctgtgataaaaacacaggacttgtatttagtttgtatacatttgtgaagtgcagccagagaattgcagtcgtgtaaaattatgtagccactccagacctccaacttatctgtttgcctttggctgtaggggagcaaaactacccaaaacactggaggggcaaaaaaaaaggcaagagtaggaatgcaggcctacacaccatatgtctaaatatttaagtcatccatcaagccaacaaactaaatgtcaccttattctggccaaaactcaggtcaaactgtgaagagtctaaatatgaatctgccctgaagggcagattcatagaagactcaggacagacccgtagaagaggcccaagcaggccctggaagtgcacgtggaggccacaaggtctcctaccttgacaaagatacctttgtagccaccttgaagggcagattcacatttagactcttcacagtttgacctgagttttggccagaatgaggtggcatgagagagctgccccaagcctacttctcttcccacctccagctccatcatattccagaactcccaccacctgcatacagacattcagctgcacaagccccctccatgctacagtcaacaggatctccaggccacggctcaagcccaggtactcacatcagtggttctatcaacactcaggacagacccatagaagaggcccaagcaggccctggaagtgcatgtggaggccaccaggcaaggaattctggagtcccaggtactcataactctgggtggcatggcccctttgcaccatggactgtttgcccttagaaagggatggatctgagctgggcgcagtggctcatgcctgtaatcccagcactttgggaggccaaggtgggcagctcacctcaggtcaggagttcgaaaccaacctggccaacatgatgaaacccagtctttactaaaaatacaaaaattagccagatgtggtggcgagcgcctgttatctcaggaggctgaggcaggagaatcgcttgaacccgggaggcagaggttacagtgagtcgagatcatgccactgcactccagcctgagtgacagagcaagactccgtgtcaagaaaaataaaaagaaagggatggatctcagaaaggccagagatgagctttctaaagcccaaggcccaggagagcggacccccttgcctcagtcaaagaataaccttggtcaataaattgggttttggggtcaaacttgacaaccacatgatgagcaatttacgtaaagtctttctgcctctgtttcatcttgtttttttcttttttcatctttttttccttccttccttccttccttcctccccccctccctcctcccctcccctcccctcatctcctctcctctcctctttctttctttctctttcatttcttttttttgagacagggtcttgctctgtctacccaggctggagtgcagtgatccaatcatggctcagtgtagacttgactccctgggctcaagcgatcctcccaccttagcctcccaagtagctgggaccacaggtgcatgccaccacacccatctaattttcgtattttttttgtagagacagggttttgccatgttatccaggctggtctcaaactctggagctcaagcgatcctctggcctcagcctcccaaagtgctgggattacaggcattagccattgtgcccggcctgtttcttcatctttaaaatggagagaagatgtatattctgtcttcctcaaaggggttttctgaaagtgaactttgttgaaacctttgagctccttggcagaatgatgttataaaagcagagagtgttattaaaaggtgttatctttcctagcatgattttagagagtaattagatctccctgaccctccatctcctctctccttcttctcctacctatttgaagtcgaccaccaaaatcattattttttttttaattgagatggagtttcaccttttgttgcccaggctggagtgcaatggtgcgatctgggctcattgcaacctccacctcccgagtagctgagattacaggcacctgccaccatgcccggctaattttttatattttttagtagagacggggtttcactatgttggccaggttggtctcaaactcctgacctcaggcgatccacctcagcctctcaaagtgctggaattataggtgtgagccactgtgcccagcccaaaatcattctttttggaattttgaagcatataattccaaaaggtatgaaggtaatcacttagattgctctaataagggaatgggaacagttaagtcctatacaaataagacaaagataagatactacaaaaaggggatgagcccaagaaaaaaatcaaagtcccagagagagaacagccattgattctaaatacacaagtctatggccccaacccaaacttgtttcactaagaacaacctgtggtttcgagaatctggtcatcccccacagtgaatacatgaacacattgtaatgtttgaaatgtttatttttcttgttgatttcttactgttagaagagctaagtgatttggcccaaagtggctaagtgattcggccagtttgtacacagggatataagtttgctgacaccaagctcatactttacaaatgtaatatcttcataaaacaaaaatactgggccgggcgcggtggctcacgcctgtaatcccagcattttgggaggccgaggcgggcggatcatgagatcaggagatcgagaccatcctggctaacagggtgaaaccccgtctctactaaaaatacaaaaaattagctgggcatggtggcaggcgcctgtagtcccagctgctcgggaggctgaggcagaagaatggtgtgaacctgagaggcagaacttgcagtgagcccagatcacaccactgcactccagcagagcaagactcaaaaatatatatatactgaatctcaaaagctagagcctaagagatgccccttaaaaaagaagcttacaagtgtgaattttcttccctccagcccttaggttggtttgtcttttagtatatttcaataagcttccccctccccatcccatccctgccccccacaccaacaccaaaaccccaagtccctcctctaggtgactccttccaaatacataggaaggccctcctttgttgctgtttttctggagaggctgattctgtaaatgtagcctgggtggcttgaggttctattctgagatgaccctggcatcttctaattacagaatcaaccttcaggcagctgtggccttgcagactctgctggaggtcatggaactacagaaaagctcaatcttatcattctattgaggcttttaaattggagattacctaaatggcattgtttggaggttgctttgatatatgttaactcatctgcataaatgtacatgtacacattgtttaaaataccaatgatactggttgctagaaactctgaaaaaatagagtaatgcaggaagtcaatgaagaataaaaaataatatattttaaaatgatgttttaagatgaatttgttatgattaagaagacctggtggggcacggtggctcatgcctataatcccagcactttgggaggccaaggcgggcagatcacttgaggttaggagtttgagaccagcttggccaacatagtgaaaacctgtctctactaaaaatacaaaaattagctgggcgtggtggtttgcacctatagtcacagctactcgggagtctgaggcaggagaatcacttgaatcagggaggtggaggttgtgatgagccgagattgtgacactgcattccagcctgggcaacccagcaagactcagtctcaaaaaaaaaaaaaaaaaaaaaaaaaaagacaaatgcctaatagctgaaatcttagagattttctggagagtgagaaatgccttaaaataaaataaataaataaataaaaaataagagggataaaaggacctgcagttcaaattgagtcagcttaattccaatacacagttagacacagaaacaaatcgagcaatcaatggtcaaataaaaatgtaccaggaaccatcattatttgtgcagtagaccgtgtattgcagaggctctcaatcaattcaatttaattggaccaatgtgatcctcttctgtattaatgtggctcctgttgacatgcaagcaagattcaaaattattattgcttctggacttgagtaagatgtttgttctgtttgtcattgggatcaagaggttagccttggctgggcactgtggctctggcctgtaatcccagcactttgggaggttgaggcgggtgatcacttgaggtcaggaatttgagaccagcctgaccaacatggtgaaactcatctctactaaaaattcaaaaaaaatttagccatgcatggtggtgcatgcctgtagttccagctacttgggaggctgaggcaagagaattgcttgaactgggaggcagaggttgcggtaagccaagatcatgccactgcactccagcctgggtgacagagcgagactccgtctcaaaaaaaaaaaaaaaaaaaagttagcctgctggattacagacaagtactgcatattccactggatttctagttgattagtgagtgataattctttttaaaaaccacccttccaaccctctttccttcaagctatccccttaagagccaaactgctggaaagatttcatctctaccccctcccttttattaacacctcacccactgcagtcaaattttcactctcacagctctgaatctattctgcccaaattcattaacgacttccttagagagagagaggccagggacgggttgggggggcaaatgtgatctctttttttctttttctttataaaatatttttaacatagaaaaataaagaaaaatatcttaagctcagaaaaaccgcttaattggtggtgctgttgacctcttttaaatccttaggctattcagtctctggtatttgacactactgaccacactttccttcctgaaactgattcctctcttttatttcatgaatctggttctcttctgattcttctgcctctttaaccactctttttctgactattgtttctttatagatctcctaatactggttttctcttttcatttctacttgctctcctcatcaatattattcacgcccttggcttcatttaagccctgtacctccagctcttgtctccttgccaggctcacccaccgtgcgccctatgctgcctggtagaatatccagcagcatggtgtgttggagccagcacacaagctcacaagagttgtttttgcatatctctttttgtttgtttgtttgtttgcatatctctaccagctagcttgaaatcggccaacggcatgaatattacaccattggaaatccaatataaatcagtgtcgatgaaaagagtaaaactctgtaaaatatttagagatttatggtgagccaaatatgagtgatcttggccctcaggagacagccctcaggagatcctaagaacatgcacccaaggtggttggggtgcagcttggtttttagggagatatgagacttcaatcaaataagtttaagaaatacattggttcagttcaaaaaggcagggcaacttgaagtgggggcttctaggttatagatagatttaaaatttttctggttgacaattggttgagtttatctaaagacctgggatcaatagaaaggaaatgtctggcttaagataaaggattgtggagaccaaagttctcagtgtgcagaggaagccttcaggtagcaggcttcagagagaatagattgtaaatgcttcttaacagacttaaggtctgtgttgatgttaatgccagagaggcataatgaggcctgtccgacccccacttcccgtcatgacctgaaccagtctttcatgttaaattttaagagtgcccttgcagaggaggaagttcattcagatggtgaaggggggcctcagaattttatttttggtttacatcagggttttgtttggtttggtttttgtatggaaagccacttgttaacatttattaggacaaaattttgcaggtcattctacaagtaaatccaaaacaaacaaatttcttgtctttccttcaaatctccttctaccatctgcctttttaaaaattttcatttaatgatatcatcatccagacattcactatgggaaatcatagtcatccttgcttaactttttcatctgtctctatctttctcttctcatttgaaaaagcaccaaggtcaggtcaagtatacctcccaaatattttatttttttaattcatcatttatttttcattcccagtgtctaagtccaagccaaacatctgggcttctgtattgcagaacctccaaactgctgttcctgtctctagtttcttccccttcctatttgtcttccctattgcagtaaagtgattttttgcttggggaaaaaaacaaacaagcaaaccaacacaaaaacaatctaatcatatattttctccctccaaaaaaaaaaatttctttttttttgagatggagtctcactctgtctcccagactggagtgcagtggcacaatctcaactcattgcaacatctgcctcccgggttccagcaagtctgctgcctcagctgcccgagtagctggagttataggcacatgcaaccacatccaactaactttttgttttttcagtagagacggggtttcaccattttggccaggctggtctcgaactcctgacctcaaatgatccacctgcctctgcctgccacagtgctgggattacaggcgtgagccaccgcgcccagcccatccctcaaaatttactatggttctcctttgctcacaaaggaaaaataccctcaaagttctgtaagaagacctacaaagcctctgaaaacaagatattggaaggcctttgaagcctgatcatatgacctgcttcctcctccatcctcttccatccatccacaccccaccccttactcacccccattctaccaactcacgactctcatcatactttcccattgcttggaaatgcttcctctcatctccactcctgtcgtcctgttatgcttttattctagaagcagtaggaaagaggggcagaaaaaagaaattcacttccctcattaaatggaaagttgtgagatagagggtatatgaagaaagagagagagatttttaagtatccaaattgataggcaaatattacccccaactcagatccattatcaagtgtaacaatagattcacagaagcagtcagtacccttaaatttgccaagaaaataattggactcaggggattaaaagaaatcaagcgcttattataatagaagtagtgcatctgcgtttctttccttattcagagtacttttttgacacttaagaatccatattcctggctgtgatttctgggatgagggactgttttatttcttagccaggagcttttcttttctctgacatattaataagagagtaagtcattagaaaaaaaaaaaatcctaggaaatgttccagatactgttttctattagacttctagagagacaatcctctttctctttcagcattttgggaacgatttcttcaggagtgcatggtttttcctttgttgccctcaatagtctgtgttgttttgacccatccttgcccagtattccttatgacttctggaattgtctggacagaagaaatacttttgccttgtcaaaggttaaatgtggagatgtgctatgaccccactgtgggagcaggccttttattttccttctgtatctccattcttctggtgactgacgtccagtgaaattagagcaatttcttagctggctacttgtcctggtgtgtaaattagtgaggaatgagctccattcatagagtcctgggcttgccacagagcggaccccaaagctggtttccccttgagtggctcaattacctaacagagttcaacaggaagcccccacatctgcctactcaccactgggattggaagccctggacacactgcctgaatgagaacagaaagctaagttgggggtgcagtcttaaggtatctaaggaaaatagaataggaggttggggaaaagagggaaaataatgtaatcatactcataaaaactgagggtgttagtagggtgcaaagaggcccaacattctgatagtttagcaaaatgtatcaagaggctttggtccaggaccagtggctcatgcctgtaatcccagcactttgggaggccgaggcatgcagatcacctgaggtcaggagtttgagaccagcctgaccaacatggagaaaccctgtctctactaaaactacaaaattagccaggcatggtagtgcatgcctgtaatcccagctactcaggaggctgaggcaggagaattgcttgaacctgggaggaggaggttgtggtgaaccgagatcacaccattgcactccagcctgggcaacgagagcgaaactccgcctcaaaaaaaaaaagcctttggcccactaattttacttggaggaatttatactaaggaaatatccgatagtatggtaaaaaaaacttatgttcaagaatgttgtcactattttattgatgagtgaacattttaaaaatgcttaatcatctgataacaattctaaaatacacattgataaattcacatgatagaatgttatatagccatgaaaggtgaaaataatgttttcaaagagttgtgatataggaaactgctcatggtaaatgcgaattgaaaaaaaaagcaaagctatatttatgtgtatggttaacattcaataaaaaataactgttactatattgataacctttttcattgaatatatgtgcctagaaaagactgcaaaaaaaaaaaaaaaagaaaaagaaaaaagaaaaaaaaaatcccagataggtgctaacagcaatcacctgtggatggtaagattataggtaattttttcatatatgtctgtattttacaaaatttataaaataaacacatgctatatatatgtatacacacacacacacacacacacacacacacacgtaaatatttatatatatatatatatatatactttattttttgagacagggtctcactctgttgcccaggttggaatgcagtggccccatctcggctcac

SEQ ID NO: 1016 - DNA, 89011 bp, Homo sapiens
acttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcgcttggacacaggaaggggaatatcacactctggggactgtggtggggtcgggggaggggggagggatagcattgggagatatacctaatgctagatgacacgttagtgggtgcagcacaccagcatggcacatgtatacatatgtaactaacctgcacaatgtgcacatgtaccctaaaacttagagtataataaaaaaaaaaaatttaaaaaaaaaaaaaaaagaaacactcaaaaaaaaaataaaataaaataaaataaaataaacacagctttgtgttatcaacagattgttttgatcaacaggttgtgttggtgatgctttcagggaactaatatgctaatatcctacaacattcaccatcttatatttctctttctttcttttgagagagagagagagagatcgagagacaaggtgtcttgtaaggtctgggctttctgaaaagaaaaaaaaaatagagacaggatctcgctttgtcacccaggctgcagtgcagtggcacaatcagctcactgccaccttaaactcctgggctcaagcaatcctccacctttagcctaccaagtagctgagactacagaaatgcaccaccacaactggctaatttttttttttttttttttttttttttttttgtagagttggggtcttgctatgttgccaaggctggtctcaagtgatcctcctgctttggccttccaaagtgttgagattacataagcgtgagacattgcatccagcccttatatgtgtggggttttttttagcttatttttttcagtcttctagctcttctgcaattaaccactattaacagtttctttccgaaatgtttgataatttacttgtatttaattgcttgtgaagctatctatatgtttttccatgtgataatttactgtttatattgccccccatgttatttatatcagatatattctcagtttggctgctttcaatattaatatttgttttataacattctctttaaaaattatgtatacatatttctcttttataatatcatcctttgtttccagtactcagaagagtatttttttgtctagtgcatctttttatgttagttcatttttttctggtattttatgacctatcaaggatgtactgtatgggatgatatgaagtaaagacctaaattaatctttctttctttctttctttcttttttttaatttgacagagtcttgttctgtcacccaggctggagtgcaatggcacaatttcggctcactgcaacctctgcctcctacgttcaagtgattctctgcctcagcctcctgagtagctgggattacaggagctcaccaccacgcctggctaatttttgtattttttagtagagatggggttttgccatgttctccaggctggtctggaactcctgaccgcaagtgatccacccgcctcagcctcccaaagtgctgcatttacaggcaagagccaccgtgctcggcctaatcatttattttctatgttgatatcctgttgcccaaaaaatacggaacaattcagcccatttgcggtagtttgtcacaagttaaaagtttatcctttaaatatacaaggaacatcattctgtaccactgataactttcattatttgtaaaagtatatactctttgtaaaaattatctaaaactttgaatagttaactcttttttatagaacctaagtctaattcaatgagttcattcattatttaacatattctttgaatttattcaaaagaatttcactgtatttcaatttttaataattacaggaagaatagttttacaatagaagaaagttttttttaaaattcatgttaattcaattatctgtatgtcttttttggtccctggatattccaaaactatatatatatatatatatatatatatatatatatatatatatatatatatatatatatattttttttttttttttttttgagacagagtttcgctcttgttgcccagactggagtgcaatggcatgatcttggctcaccacagcctccacctcccaggttcaagccattctcctgcctcagcctcccgagtagctgggattgcaggcatgcaccaccacgcctggctaattttgtatttttagtagaaatggggtttctccatgttggtcaagctggtctcgaactcccaacctcaggcaatccatctgccacggcctcccaaagggctgggattacaggcatgagccactgcgcccggcctctaaaaagatttttgtttgttttggaagtataaaaatgttaatattattcttggggggagaatttgggagtaattattttattatttcctagttacagtttttaattttttataggaacatgaattactagctcaatttaaaaaatgtgaagggaaaacaatgtttttactgttctcacttaaatttggatatgtgttccaagatactacacaagaatgaaaatccttattaaatctatctctaatgattaaccaaaagtggaccactctgcttatcttggacattgaacttttgtagatttttcaaagttatttaagtgcaaaacttaattagttaacatttgcttgctaaatagaaatgatacagcatattttctcctgaatcatgtagatgagtcattcttttctattgaattatctctgtgcaatccatgatttacactgcagcacacccacactgagtcattaagaagagatgttttgagaccattaagaggagatttgggatcaatctttttacataggaccagcagagctaagtttagaattcaggtttcctgactcctttatttatgttttgcagtgtttcattgtacagccttcctatccctattaaaaatatcaaggcattcgtcccatcttttgatgcttttatgattctcagtgattccagaagattacagatcatggttctgcaatgcttctgtcagtccttttagaacccattttgggctgcaggaactttcatattcattcatttcattttttacattcattaatgtaaaaaagaaaggctcagaagcccctgccttcccccaccccaagaataaccactgtgaatagtttatttgaatcaacgtttatattgtttgaatctgttaagtgtaaatacataattttttaaatcaaaatggaatcacactattctaccacttgcttttttaaaatagactttatttcttagagcagttttaggttcacagcaaaattgaacagaaagtatagagacttcacataatgccctgcccccattatgtatggcctccctcatcatcagtttatcaccagcccccaccagagtggtacatttgtgtcaactgatgaacctacattgacataacactatcacacaaagcccatagtttacactaaggttcactattggttttctctattctatgagtttggacaaatttataatgacatctattcacaactatagttatcatacagaataatttcactgccctaaaaatgctctgagctccacctattcattcctccctccctgctaacccctggcaacctctgatctttttactgtctccctagttttgacttttccagaatgccgtctagttggaatcatacagtatgtagccttttcaggttgacttctttcacttaataatatgcatgtaagtttcctacacatcttttcatggctcaatagttcatttctttttagcactgaataatattccattgcctggtatattatgactattgatgtttaatatgatgattgatacagttggattattatctaccatgtttgtggtgactatttctctttgttgtctttgttctcttttcctattttttcttccactctttttttcacttttgtggtttagttgactgttttatatgattacattttctcttctttcttagcatatcagttatacttcctctttttcttttttacatttttagcagttgccctagaggttttttgtttgtttgtttgtttttggttttctttttgagacggagtctagctctgtcgccaggctggagtgcagtggcaccgtctcggctcattgcaacctccaccttccgggttcaagtgattctccagcctcctgagtagctggattataggcatgtgccgccacgcccaggtaatttttgtatttttagtagagacggggtttcaccatgttagccaggatcgtctctaactcctgaccttgtgatttgcccacctcagcctcccaaagtgcccaggatcccagccatagagttttaaatacacatttacaatgaatccaagtccactttcaaagaacactatgcactttacaggtagtgcgagtaccttataataacaaaataatcctaattctccctcccatcccttatgtctttgctgtcattcatttttgttatacataagcatttaaaaatatacacagaaatatgcatgattgaatacattgttgctattattttgagtgaactgctattttttaggtcagttagaattaaataatttatttcaccttatttcttctccagtgctcttcctttctttatgtaaatccaaatttctgacctatatcattttccttctctcttaagcaggggtccccagcacctgggccacaaactggtgctggtccaaggcctgttagggctgcacagcaggtggtgagcagcaggcttcttagctccacctcctgtcagatcagcagaggcatgtgattctcataggagtgtgagccctattgtgaagtgtgcatgtgagggatctaggttgcacacccttatgagatctaatgcctgatgatctgaggtggaacagtttcatcctgaaaccattccccacaaaattggtctctggtgccaaaaaggttggggaccactcctctataggaattcttttaacatttcttgcaaggcaggtctactggcaacaaattccctcagtctttgtttgtgtgagaatgtatttatgtatttattattattttatatatatatatagagagagagagagacagagagagagagagagagagagagagagagtgtctcactatgctgcccaggctggactcaaactcttggatcaagcaatccctccacctcagcctcctgaatagctgggactataggcacgcaccactgtgcctggcttctctttacttttaaagaataattttgtgggtacagaatgctggctgttggtggcttttttctctcaccactgtaaatatttcattccattctcttcttgcttgcatgcttgctgaggaaaagttggacataattttcatcttttctcctctacaagtaaggtctttttccccgggcttcattcagaattttttatctttgatttcctgcaacttatatatgcatgcctggttgtagggcttttgtttgtttgtttggcatttgttctacttggtgttctctcaacttctgtgatctgtgatttggtgtctgaaattagtatgagggaaattctctttcattattgcttcaaatatttattctgttcctttctctggttattctcttcctgctatttccattacacatatgttataccctttgtagttgtcccatagttcttggagattctgtttatatagtcttacttatttttgcagttttggcagttattttcaagttcaaatattctgttttcagccttgttcagtctaccaaaaagcccatcaaaggcattctttatttctattacagtgtttttgatctctagtatttatttctttttagttctttcttagaatttaaactctctgcttacatcgacccatttgttcttgtatgctgtctactttatccattagagcccttggcattgtgatcatagttgttttaaatttctggtctgataattccaacatcccagtcatatctgagtttggttctgaggcttgctctctgtctctttaaagccttttttttttctttttttttttttgccttttagtatgcctggcaatgttttcttcatagctggacaggatatacggagtaaaaggaagtgctgtaactagacctttagtagtgtggtatacagtgggggagggggagaggaagagttctatagttctgtgaagaggtctcagtcttttagtaaacctgtgtctctagactgaatttcacaagtgcttctcagttcctatctgccccgatccctgttaggtgggacgtgatggctagagtgggctgcagctgggtattttcagttttcatgtggaaggctagaagagactggagttcttatttcccttctccggcatcatttaggctcctataaatcaagagcattaggctctatttaaacagtttttcccaagggcagactttgtttagaagagaagaatagagtgtccaggtatatttcaaatggttacttttcctatcccctctgccagggacatggaagcaggaggagatttttctctaataaaaagagaacaatatttgagaacctctttgaattcctatgggtaaactcatgaaagtgtggagatcatcccctccttatggctgagtcactctggaatttttctctctcaaacttatctacactgggcctccggcaattcaattacagttcaggttttcctgccctagccctggttcctgctgagatttcttttcttttttctttttttttttttttttttttttgagacagtgtctctgttgcccaggctggagtgcagtggcgtgatctcaagtcactgcaagctccgcttcccgggttcacgccattctcctgcctcagcatctccgagtagctgggactacaggcgcccggcaccacgcccggccaattttttgtatttttagtagagacagggtttcactgtggtctcgatctcctgacctcgtgatccgcccgcctcggcctcccaaagtgctgggattacaagcgtgagccaccgcgcccggcccctgctgagatttctgcgccagtaaattgtgatttttgatattctcttgtttatctcttcagtttgccctgtaaccttatctctctacagatctaagaagagttattgatttttctatttgttcagatttttagttattgttaggaaagattcatgacttcctggctccttacttgcttttctcattcaatattccctatgagtacatattttatactttaagcaacttgttttgatgaacatttagattctccaccctctctttttttgattacttagaacgtttaggccagacacgatggctcatgcctgtaatcccagcagtttgggaggccgaggcgaatggatcgcttgagcccaggagtttgaggctctacaaaaaaattaaaaaaagaaaattaggtgttaatccttgaccttatatttctcaaagttttaccaagagttcccccggactccgagtcctaccaccagtgccaagagaagtatgcagcctaaaggtgcaccctgccccaagtgagatctcttagttccacagctgacctttcctggctcttctggtgagtggtatggaaaatgatggagaaactgccatatgttttcataatggtcagaccaatttacatttccatcaacagtatactagggttcccttttctccacacccttgccagcacttatcttgttgttttttttttttttttgtaatagccatcctaataggtatgaggtggtatctaactgtggttttgatttgtgttttccagatgacttgtgaagttgattcagttgtcatatacctgttggccatttatatgtcttctttggaaaagtgtctgttcaagtcctttgcccactttttaatttgttagtgtatgtttgctattgagttgtatgagttccttatagtatattgtggatattaactcttcatcagttatatggtctgcaaatattttctcccacactgaatgctgccttttcattttttttatgtgtatacttgacttttaaaatcagtaacaaggtccatacaattcacatttggctgatatgcctcttgattctcttgtaatttgtaagttcctttgactcctttccttcttttaatttatttattaaaaaatggaatcatttgcactatagaatctcccacattctggattttgacaattgcattccaatggagtcctttagcatgttcctgtgtttcttataatccggtagttagatctagaatttgaccagatttaaggccaattttttttagctaggatactgcatgggtggttatgttttagctaggataccgcatgggtggttcatgatatcatgaaaaaagcatgttcttaaagcaatttaagtgacagtacaaaaggttgggtcaggtggggcacggtagctcatgcctgcaatcccagccctttgggaggccaaggcagaaggattgttgaagcctggagtttgagaccagcctgggcaacatagtgagaccccgtccctacagaaaacatttttttaattagctgggcttgttggcatgtgcctgtagtcccagctactcaggaagctgaggcaggaagatcgcttgaacccatgaggtcaaggctgcaatgaatcatgatggcaacactgcactctagctcaggcaacagaccaagaccctgtctcaaaaaacaaaaaacaataacaaaaaaagaaaaggttgggtcgatgacagtttctagcgactgatgccaccactctgtttacagaatcacccctctcctctggccctgatgttttatcatgatatcatatttacaatgcctggcaaaggcttcattcccatttggcatactacctctcaggcaaatagaacttttgaaagcctgtattatgtatataacatataggctcacactggataagctattttataacctgacttcttcaaagaaagtttacatcatgtttaaaccatgttttagattctatatttttaattaaaaatctaaggaagaaggatatttcacatttctataaactctaagatcttgcagcagaagcgaaactgcacatttaggggtgcctgcccctctactgatgctgccctttgtgggtcatatgtccttaggaaaatgaaagactgtgcactcttgatttgttggccagctctgttgacatctttcagtggttccttttatgtatggccactcctacagaggcctcttgtactttgggaactggtgagtctccctgtccctagggctttttagtcacatgtccatccactgtttcaatgtaacatgcatctaggcaaggttaacgattaaatggttgggatgaaaggtcatcctttacggagaacatcagaatggtagataattcctgttccactttctttgatgaaacaagtaaagaagaaacaacacaatcatattaatagaagagtcttcgttccagacgcagtccaggaatcatgctggagaagttctgcaactctactttttgggtgagaaattacatttatcttcatattgactcttctcagactcagaacaagtggtagttagttaacttagggtggtcaccaacaagaaccagaaatgttagatgtgcaattggtctaaagctcaggctttttagaaagcataattcataatatctccagaggatataagatctgggaaatgtaatgcaaattattctctgtcatatgtttttttatatcagactcttgtactagctagtcgcaaaattgccttctctaaagagaaacaggtaaaaaccttccaatttaatccgtgtgaggaaggagaattgttgttgcatactttgctagtagaaggaagagaagatccgtgactgagtcttgctgagacatgttgatgttgaaatgataatgataagttctagaactggcaactaatgatatggactagaagttgagtctagggatgcaactttgggcatcatgagcattgaaataatttttgaacaactagagttgggtaatattgtttttaaggaaaagaagagacaccacttagagggtgaacaagaacagtgtaacattacggagtcatagatagcaaaaaatttcaagataggggccaatcaacagtatcaaaggtctagtggaatagaaaacaaaaaaggaccttagatttagtgattttagtaagggtttggtgagaaagtatcatctgcaaactcctagcctcagcatcagaatcacctggggcaataaatgtagtttaagtatcttaagtgattcttctgaattctaacatttgataaccttatatagaggtgagaggggcagggatgagatagcagagcacctgggcagcacctcgtgtcttagaaaggacctgggtcccaagaccctcgaggccaggagtgtataccacggcaaggtggatcttcatgggctatagtatctagacaggccatctcttgagaattctttctgagaactacctgacaaactttcttggtcagggcatcgcaagcaattctttaaagagtctgtataaataatcatataaaacaatttttaactatttataggaaaagaaaaatccacactcatgtgactcagatacaagaattggtgcccaccccccaccccccaacttccacttcacaagacacttccatttatcgcagaatgcaaagactgcacaaaacttgctggttggaagccttctgtccaacaatgctgttgtcactgctgtgctgaaactggccaggtttttaatgtaagcgctttgggccatcagagagcaaatgttacagtatgactaagcattctccctgcatggcgcctgcatgtttgaatatctgccagtgagttcagttagtgctagaaacttgaataattttttatatcccagggaactattctgtcctttaaactggggaacagtccttcttcatcctataatttggcaaatgcagtggtgaggtttactcagaatagctggtacaaaattcacttagaatcacaagaagacacgtttttggagggtgggttggccagaaagtgactacatttgtcattaaatggtgaatttgtatccatgtgcacaaataggaaaatacggatagttaaagggtaaggctggatatggatatggagttgaatttaaattgtgtgaaagcagtgggatgtgctgcagggtggttttctgtcttcacaatgcatgtatgcaacaatccttcccctttggtctccagaattcctcattcctggacagtccggaggcagacctgccactttgttttgagcaaactgttctggtgtggattcccttgggctacctatggctcctggccccctggcagcttctccacgtgtataaatccaggaccaagagatcctctaccaccaaactctatcttgctaagcaggtaaagttaacaccactgtttctgaactctaattccttggtgcacagtagagacattttcttggtggttagtgttctcttccttgtctttaagcagctgtcccaggtgccattgtctcaggtagagccaggctcaaggtttccctcacgggtcccttgctgcatttcttaaatcaaagtggctttgatttttgcataagaatggtgactcttaattcttgtggatattgggttccctaaacacaaagggcatataatcaatcaaattatctttatagcatttgagaaatgaacactggatcacctgtctttaaacagctctaataaatcagtggactgtaattcagttggcatctacctcgtgaaaatgagctagataatggatctcctgccccactgaggcaatccaactatcactcatcttcaaaaacttgggtccgaaataaggtttccattttccccgcatatttgatgagtcaggatgatcactcacagtagaaggaggaggggtaagtgtgcacagtgacaagcacgagtagggaaataatggaaaggacaggtctgcgggagaggcccaggaggggccaggaggggaggagccctcagccagctgcaccaactcactcagggaagggtcttgtgggaacccaagaccctcattcgaggttgtaaaattatctcataaaatcttccatctgcttcttttcactatttttttttctatctctccttattatcattattactaccattttaaatggagtctcactctgttgcccaggctggagtgcagtggcactatctcggctcactgcaacctccacctcctgggttcaagcaattcttatgcctcaacccctcccgagtagctgggattacaggagcacgccaccatgtccagctaatttttgtatttttagtagggcgggatttcgccatgttggccagactggtctcgaactcctgacctcaagtgatccctcctgccttggcctcccaaagtgctgcgattacaagcctgagccacctgcacagcctctgtcagtccttatctttcaacaggtttttagaaaggcaaactagattccattgttctactagcatacctaacaatgactcaggttacctggaatcttaaaggaggaaagagcttggccaaaggaagtggatttcaccttgacactttgaggttggggttgatcgtgggttttattagattctgattcaaaaaagaacagtctcagagcttgggacagtgtcactgtctcccttgttgacctgagtgcccatcacaggacctagcatgtttcaaacactcccactggaatacaacatttgttgaatgttggtgttaaatgcattctgggaatagtggttgattcaagagtaggttagagctgacctcagtggtacatacctgtaatcccagttcctctggaagctagaagtggtaggatcactagaggccagcctggcaacatagtgagtccccatctcttaaaaaaataaaataaaataaaaataaaaaggaaagaaacatatgttagactttgaacattctgaacattaaacaactctgaacatttaataacattctcagtacccttggaattgagtcattgttcgaggttagaagcaatcaagttgggaggcttcttctactttctggagcttccaagaagaagctggttaatgagcaaaccaatatcccatcctaataaaagctattagttaactcttttacaaaatactttattgagatataatgtacataccatacagttctctcatttaatacaattcaggccggatgctgtggctcacgcctgtaatcccaacactttgggaggccgaggtgggtggatcacttgaggtcaagagtttgagaccagcttggccaacacagtgaaaccccatctctactaaaaatacaaaaacattcggctgggcatggtggctcacgcttgtaatcccagcactttgggaggccgaggtgggtggatcacgaggtcaggagttcgagacgagcctggccaacatggtgaaaccccgtctctactaaaaatacaaaaattagccaggcatggtggcggacgcctgtaatcccagctactcaggagactgaggcagagaattgcttgaacctgggaggtggaggttgcagtgagctgagatcatgccactgcactccagcctgggtgacagagcaagactccgtctcaaaaaaaaaaaaaaaaattagcctggtgcagtggcacacacctgtaaccccagctactcaggtggctgaggcataaggatcacttgaacccgggaggtggaggttacagtgagccaagatcgtgccactgcactccagcttcagactctgtctcaaaaaaaaaaaaaatgcaattcagtttttttcagtatattaacacatatgtgcaaccatcaccacagtcaattttagaacatttcattatctttaaccccgtctcctccttccccttatccttagcaaccgctaaatctcttttctgtctttatagatttccctgttctagacatttcatatgaatggaattatataatatggttcttttttgattggcttctttcacttagcacaatgtgttcaaggtttatctatgctgtaccattgctataccatgtattgatattttacccctttttttggggggacggagtctcgttctgtcgcccaggcaggctgccagcatagattcctgccaacagtgtgttaaagtgcatgtccttgcaccattgtcagcattgagttattttcaacttttatgtgtaaacatgacatctcactgagttgctttgcatttttatgaatactaacgcaattgtttttttaatttgttaagtgtatttcatttgcgaattgtctgttcatatcacttccttattttttaatgggggtgtgagtgtatttaacttatcttttgaacggataattctcagaggatcacaaagttcaaaaagtacaaaaggagctgggcatagtagctcatgcctgtaatcccaacactttgggaagctgaagtgggagaattgcttgagcccagcatttcgagaccagcctggccaacttggtgagaccgatctctacaaaaaattaaaaaaattcaccaggcatggtggcatgtgcctgtggtcccagctactcgggaggctgaggtgggaagatcacttgacaagttcaaggaggtcaaggctgcagtgagccatgttcacaccactgcacttcagcctgggcgacagaggtagaccctgtctcaaaaaaaaaaagaaaaaaaaggacaaaagggtacccagtactctagtcactcattcatgtcttagttggcaaccattgataccagttcctcatatctccttccagaaatagcctgtgcttttacaaacagctacgtacatatattttttcacacaaatgctagcgtcccatatgtgcttttctgtgtcttagagctccttccattttagcacataaaaatctgcatttttctctctttttgtggatattttattcatttgtacctaagcagccaaactcgtactgataccaccatgcagccaaggttactgaaacctctttgattagacttcagtcatatcccacccccaaatagacccaataggtacaatgaaaaccagtatatcaaggcagaatacagagctgtaaaacaagaaaaatcctatgagggagggagggaaaaaggaagaattccgccactacccagactaaaatcgagttaatatattcatctccacacgttttcaggctgcatgttcatggagtaatttaggaataaacctatgatttgtgaagcactgaaatacttagtggtttgctgtattacatcatagctttccccagcagtttccaagacagcttccaaaaactggcaggagaatttcgctggagctgcatgcaggactaccaagattcctccccacagttatgaaaccgatttttccgggactggttgttctagtcttctgggtgccaagtctgacttttctgggaatggttgatccacactggaaggtttccagatgtgttccccaggcattcctggtggtaggaagagtagaggcctgggtattctgtagatgctgagccctgagtcatattgttgcttattctttggtcagttggctttctaccacctcttagctttcattctctgtaactagcttgtatgctgtttgtagctaagattcagggtattggaaagttcttgcagctgctggaggctgcggtgtttctgtctctgaaatccatcattaattacacacagctgggccggagagaacatgattctggtcttctgtttcttctcctggatcttatcttcattcttcactgtgctcttctctgcagaaatgtgtagttttactctgggactagtggaagaattagagctttcctgaataaatagatccacggaggaaggaagatgagagagcctctgagtgggacacctcctcatatgtcatttgcaaggatggataactttcatcagggccacgagtcacaggcattggtgaaagagtccctagaattggatgctttagaataaggcaggctttggagacaagctggactcacactcatgttattgaaaaggagcggggaggggcgggtgcagtggctcacgtctgtaatcccagcactttgggaggctgaggtgggtggatcacctgaggtcagaagttcaagatcagtctgggcaacatggtgaaaccccatctctactaaaaatacaaaaattagccgggcataatggttcacacctgtaatcccatctccttgggaggctgaggcaggagaatcacttgaacctgggaggcggaggttgcagtgagatagcaccactacactccagcctgggtgacagagcgaaactccgtctcaaaaaaaaaaaaaaaaagaaaaaggaaaagaaaaagaaagaaaaggaaaggtggaggaaaattaaagagctggactgtaaaaatggctaaggctttaagatttaagtatctaggtagaatatcttagagaaatatgtaaaatttctccaaatgtaaaagtatcaaaaagccaggatgaagtcagtcccctccacattactgggagacaaccagctcaatcccacaaaaggtctgcttctttctttgtaatgattccttgagatgctgttatttgaatgtaccataatttatgtgtcctgtatgacatgaatttcattggtttctaatattttgcatcatgagcaatgctgccatacacagctttgtatatacttgtgtatacaagtgtgtctataggataaattcccaaaaatgaaatgactgagttaaggatatgtgaactcagaatttttatacacagtgcaaactgccctcaaagaggctttccttggtctcatcaactttgtatcacattttttgatgtttgctaattggttaggcaaaaatgttatgtttcaaattatatatactttcaaattgtattctcatattaatgaggttaagcacatgttcatatgtttaaaagccttttgtgtttttttaaatccatttaatttatatactcatttttttacattgagttattagggtatttttaaaaattactttgtagaagttctttataaagttaactggtcttttttgatatgaactgctcagtgtatttcaaatccattatatgagtttaatatatataatcttatggcaagaccccctccttttccctggcctggggaataggctgctggttagtaccctctagtcatctccaagggcaggtgccttacctctagcttgctctattttacctcctaatttacctaaaggcaaccatagcttaccgcctatgaagctacatttttttcccaaaacctcatagtctcttgtgaggaaaacaccctatagtgtattatatacttgaaaaaatgcatttcagttattaacatgtctttgactctactccttactaaataatagcactgatcctattagttaaagtaaaggtgcattcatctcctttcttggctggttttcattacaaagggcccattatctctgcctgtgccattctggataaattagacttaaaagaatgaataagggtagatggataggggcataaaagcatgaggggaggggagatggtgccacataaatatcttcattttgatggctaagatgatggtatactcagtggaggcagtaattttccccctgataggtggggatgtgggcctttaaaacagtgtaatgtgtatcatgtcttctgagctcataggacaaatactgattggcattgtctgggatcaagactggggctgagtgtggtggcttatgcttgtaatcgcagcagtttgggaggccgaggcaggcagatcacctgagatcaggagcttgagaccagcctggccaacatggtaaaatcctgtctctactaaaaatacaaaaattagccaggtgtggtggcgcacacttgtaatcccagctactcgggaggctgaggcaggagaatcacttgaacccagaaggtggaggttgccgtgagccgagactgcgcctctgcactccagcctgggcaacagagtgagactccgtctcaaaacaaaaacaaaaaacctatggcctaagaaagggaatagtgccttttaaacctagtactttctgttgctatataacaaaataccccaaaacttagcagctaaaagagaattctttaaatcttaacagtttctgtggatcaagaatttgggagcagcttacccaggttctgcttcaaggtctctcaggaggttgaagttcatatgagctgtctggggttactggcatgtgaagtcttgactggggctaaaagatctgcttctaagacgactgtcacatggctggtggcaggaagcctcagtttctcactggctgttggcggaaggtctcagttccttaccaagtggacttctccaaagagctattggagtgtcctcatgactggactggtagctttctccagagtgagcaatcggagacagagaacaaggagaaataatccacattgcttttttatgccctagccttggaagtcacacgctgtcacttctgccattttctattcaccagaagtacatccctaagtccccagcccacactcaagggagagggaattaagctctgctctttgaagagaggaatatcaaaaaatctgcagacatattttaaaacttcacactcagcattcctcaaaaacaatgatcatggcatactttgaacattattctatcacttgaactgtatgtatccattctttccagaaatatttattgtgttatctgaatcactgcataccgcttttcctatccatcaccggaaaccattctgttctaagagccttataaagaatgatatcctcttaacagtggtctttttcccttctcaggtattcgttggttttcttcttattctagcagccatagagctggcccttgtactcacagaagactctggacaagccacagtccctgctgttcgatataccaatccaagcctctacctaggcacatgggtaagacctataccacttctgccctgtttaccttttcattacccataggcatctaggtgaaatgtactctttggggatgaaattaattccaaggtcatctgtctttttcgcgggatccatagtgaggcaaagcttggttggaatggggtgaaacaaattttagcttttcatcttcatttgagcattaatgtatagaggcttcttcctaggttaagtattagctttcatgactaagatgtatatcttatgtccgcacatcttgccatctaagggtcacagaagagagctaagtttcttgatgtaaaacaatattttaaatctgtaaatattgtttttaaattgattgatgactttaaacaatggatcagtgagcttagagtttatataaacttgatatcaaaaaactaatgtctctcttgcaggcattttttcagggggtggggcctagacagtgtttaaatagcaattgaattaattgccatcaattcagtggcaactaatgacacataattatttgaactttcaaactttattgaaaaatcaaaatgtctggcaatcgcaaacctacgttcaggcagagcaatgtcagctgggcctcagtagcagtggctcctttagaccatgtgctcggcacaatccttcctgggcaaatgttataaatcatggctctttccccaccagaatgctgttttaggagcacagctaggtctaggaaatcaacatttaatttattatatctaatgtgagatggtataaggcaagattttttaaaaaaattaattgcttaatcttatattagaaaatcaagctacagacaccttgcacctaattaattagaacctgccttccgaccttactactgcaatgtctgaatttaattttcatgggtcctggaaaggtttttctagctctcaaagtaactccactaaaatgcagatagtgaccttctacattcttggctaacatcccactcaagtgtggtccatggagatgaggcactaaaagaaaaagctggatggcatgggggtgacatgttcaacctggcatctgtgtgctctctacctggccagattagtcacgacagtctcctccctcagccctcctttcttcccatgttctctgacatccttctcccctcagtcctcggttagtggcagtattcttcagaacatcatgtgaatttctctccagctcctggttttgctgatccaatacagcagacaatggtgtgtacagaaaaactcctggttcctgtccctattctggattctctcgatactctgtggcactttccaatttcagactctgatccggacactcttacaggtaaggaaaaaaagagtggatgacatgaggaggtaccatggggcaacctctaactcatagtaaatggcatcaagttgagctccaggatcgaattgtattagagggatttgatcataggctttaatcacaagcattgatatatacgggccatgtagacttcctttggacaaaaggctcatttttcctctttgtttttttcctcatagggtgacaattctaatctagcctactcctgcctgttcttcatctcctacggattccagatcctgatcctgatcttttcagcattttcagaaaataatgagtcatcaaatgtgagattctaaatatgcccatctcatatattacttaattggatgatatcttaatgaatataactttaagatgtctgggtctcacggaggcgccacaagcccagaataaggtagtacagaccattttatgacaaggaaacagatagtgatgagagtaaaatactgacttttactttcacctaccaattgtcagtgtaattaattcattcatatatctatgccagaaaatctgattatcattctactagtggctttagggtctccaaataaacacatgttgataagctgactttaacatcatatctagtttctagcacaacattatatcattaaaaaatcagtttctgattttagagtcccatgaagttcctgtctccaattggtttacatttcgatttttttgtgtctttcagaatccatcatccatagcttcattcctgagtagcattacctacagctggtatgacaggtaggaaagcctggagtatggattggctgtatccttactctctcactcctctgaaagtgtcagaaagattttttattttattattttttttttgagatggagttttgctcttgttgcccaggctggagtgcaatggtgtgatcttggctcactgcaacctccacctcctgggttcaagtgattatcctgcctcagcctcgcaagtagctgggattacaggtgtgagctaccatgcccagctaatttttgtatttttagtagagacggggtttcaccatgttggccaagctggtcttgaactcaagctcatgttccacctgccttggcctctctacgtgctgggattacaggcatgagctacagcgctcagccgaaagattaattttttaaaaatgcctcctgtgacctccatttctcttctacttagagtcagagagtgttaaaacttacagaccaacttaatccaagccctccattgggcagattgggatgctgaggagaagatggagggggatttgtttttggtagcctaggggtcccacaggagaaaagaaaggaggcagtaggacaggaaaggaaaaatttggaggcaggtttggagggtaaggggtgaaatagctggcttgggctaccagaggatctggagcaggcacccttggcctttatagttgcagggacccatttggcaggctggtgaagtctatgaatcccttctcaggaagtgttttaaatgcatgaaataaaatgaaagacattggattctaaagaaaaccaaatatattgaaatatagttaccaaaatattttaaaaacaaatgtgtgatttagtaatacaagtacttctttattaatgcattaaataacaagatctagtgatgagtctaataattaccataattttaaagtagttatgagcataagtgagctatgagaacatgtgggatttctcagcctggcatggtagctcatgcctgtaatcccagcactttgggaggctgaggcgggtggatcacctgaggtcaggagtttgagaccagcctggccaacatggtgaaaccctgtctccactaaaaatacaaaaattagcctggcatggtggcatgtgcctgtaatcccagctccttgggaggctgagacagaagaattgcttgaacctgggaggcagaggttgctgtgagccaagatcgcaccattgcactccagtctgggcgacaagagcaaaattccatcaaaagaaagagagagagagagagaagaaagaaagaaagaaggaaagaaagaaagaaagaaagaaagaaagaaagaaagaaagaaagaaagaaagaaagaaagaaagatttctaaatgctagatttcagttagatgctattacaaataacaatataatttaggccaggtatggtggtttacaactgtaatcctagcactttgggaagccaaggcaggaagatcacttgagcccagaagtttgaggctgcagtcagctatggctctgtcactgaactccagcctgggcagagaaagaccatgtctctaaacatatatataatttattttccatccatattctcaaactcctggctaagagccctgatcaagagagatggcacagtggctggacatagtggctcacacctgtaatcccagcaccttgggaggctgagatgtgcagatcacttgaggtcaggagttggagaacagcctggctaacacggtgaaaccccatctctactaaaaatacaaaaattagctgggggcctggtgcagtggttcacgcctgtaatctcagcactttgggaggcagaggcaggtggatcacctgaggtcaggaatttgagaccagcctggccaacatggtgaaaccctgtctctactaaaaatacaaaattagccaggcgtggtggtgtgtgcctgtaattccagctacttgggaggctgaggcaggagaatcgcttgaacctgggaggcagatcttgcagtaagccgaggtcgcgccactgcactccagcctatcgacaagatcgcaactccgtctcaacagaaacaaaaaaagaagaagaagaacaagaagccgtgtgcagtggtgcaaacctgtaatcccagctacttgggaagcttaagcaggagaatcactttgaagccgggagatggaggttgcggtgagccaagattgcgctactgcactccagcctgggcaacagagtaagactctgtctcaaaaaaaacacaaaaaacaaacaacaacaacaacaaaaaaccacacacaccaaaaacaaagatgccacaggggctgctttatttcttgagggcatcaaggaggcccccaaggagatgccagagtggcagagaggcagccagtgtttgaggaggaaggagcaagagcagggtaaggtgatgctcttttagctgtcttccccttctcttgtcttctaacacattcttttgcccccacccattccttttgctgctctccccactcctctgtcaagttcaaagggccaggagatggggatagtcccattcttctgtccctctatcccagaacctggaggtaggttctgatagaagtggtggagatagcctctgacccagcctgggggtctcagcctgtggttcgctcttgttccagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggtaactttcccttgagtgtctgtgtgagcgcgctgcatgtttcaggcaagggtacatcagcatcatggcgattctgtccttacatttttatagcacttcatacttctcagtgcacttcatattattaatggtattcacaatactgatactaccttagtgatggatacatggcgtgtaatgtactgttctctttcctttggggtacttttgaaattttccagaatgaaacgtggttttgaaaaaaataataccttagcatttctagattttgcaccttggtacaaattagcataagcaggcaatttgttgattcattcacttgaaaatatttattgagcacaactgtgtgtcagtgaccattctgggcactaaaagattgctcatcttttgtgagctagaaaatatgtagtaagcccatacataggttactctttgaaagtaataatagctattaagaaaataaaacaatagtgtatttggagtgaagtgcgacttgagacagggtaacaggggaagcttctcagaggagatgacatctgaacagacactcaaatgatgagatcaggccctctgagggacagtcagagggaagtgtgttccagtcagaaggagcaggcatgcgaggctgagaggggaacacatttggcttgctcagggaatggcaagaagatccaggacagggtgcgcatggggtgagatgggctcaaggaagtggacagggattaagctatgtggacccctgtgggccacaataaggaatctggactttgtctgaagtctgattgccagcggaagattttgagcagaggagtaatgagactggattcatgctgtgaaaagcttacttgggcggctccccagaggatggatcgttgtgggcaagaatggaagctagaagggaggccagggcagttgtcctggcaagggagacccatcagatgggacctcagtgaaagacattgtgagagagtatcactggtaggctgagaagctggaatttggggcaagatgagactcaggaggacataatgaggaggccaaagcatagacagaggctggtgactgagtcgtaatgccccatgtattagtttcctagggctgccatgatagagtaccacaactggatagcttaaaacagaaatgtactgtccccagctcaggaggccagaaggctgaagtcaagatatcagactcgctcccgctgaaacctggaggggaaaatcctctcttccaccttctagtgttccccagcaatgcttggcattccttaacttctggatgcatcactctgacctctgcctccaccatcacaggaccatcttctctctgtgtctgtctcttctcttcttgtaaagatatcaatcatactgcattagggccccagtgacctcatcttaatttggttacatctgcaaagaccttctttcgaaataaggcacattttaaggtattgggggttagggcttcaacatagcttttgggggtggggatacaattcaacccataacatctcacagcaaccatgaaaagaacaagcatgaaaagaacagaaaggacctctcagcatcatgcccaggcccttcactctcaggactgcccctcaggcccccacgcagatgggtctctctttttacatgggactcttaccagcttagttgcctggttttctaatctaaaatagattacaagtatcagttaggagcgggagagtggaacagtgaaggcagctagaagggcagaagcaactaggccagggagagatgatcaaaacctgtacagagaaggccacggggctcacaggctgaccaccctggagctgctcaggccagtaacagacataactctgtggacactgttgtttggttttgtacctaggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaagtgagtctccaggcctcagatggtcctttcagggcctcctctgccaccctcctttttgccactgtgtatgcaagcaggagcttttcttaaattcccattttttaaaaatgctcgtaattttcttccaccttaaccttacagcattgtgttcatgaagaccgcaggcagttttcaagatgtatgatgatatgtactttagcctctctcttttccatgtctgtctcctcatagggggccgggtaattgttaggggctgtttcttgttaaactgctaagggctgagccagatccaagtggcgggtagcatacccctggagagtaactgacttcatctctccatcgcagccttccacgggaggttcaggttaatcttgacaagacttcacaatctgtcatgacctgtggagtgaaccacctgcagggaaagacagggccaaagcattgcagtgacagctaggtggagcatttctgtcattatccattctcacagccatgggttatcaaccctaagctcttgctgctcatctccaagtaaaagccagaacgccaggctggacatggtggctcatgactgtaatctcagcagtttgggagattgaggcaggaagattgtttcaggccaggagttagaaaccaggctggtcaacataacgagaccccatctctacaaaagaaaatagttagctagatgcgatggcgtatgcctgtagacccagctatttaggaggctgaggtgggaggatcacctaagcccaggagttcgaggcttaatgaactatgatcctgccactgcactccagcctgggcaacagagtgagaccctgtatcaaaaacaaaacaaaacagaaaggacactggtaaaactgtagacttaggtctttcaaaggctttggacaattctggtcacttttgttacctacagtgtaaagatagtgtagtctagctggctgtgcatgaggagagaggcatccttggaggccttatgggtataactaacttggcttttctctggcagattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggtaagcagaatacggcaggtatcaccaaagaaaatcccctcagtaaatatgagcattgattccaaggttgaggaaaatgtgatggaaatggtaacttatctcaacacttaatgttgactggccatacagcctcctttagatgtttctttggaaattagattttgagaagtgtgttcacagacaatgggtggagaggccaggagggaaaacgtactccccagggagaagcctgcaagctgttctggtgctcaggatccaccttgcagccctgaaggcttggctacccatccatctcttcctgcctctcttgacaaggtgaaatgccttggaaaagaatataaggtcagaaaagaagctggtgaagggtcaaactcttaaaaccaccaacatttaactcaaatacttaatgaaatccagctcagagacctggtgtatccatctcaaattgcagtcttgccggagctccacctccccagaccaaatttcacctagcaacttctttttctaacctttagtgctaacctaaacctcctctgtctgacttcttttttcagtttgtaaatacattcatgctgattactgagttctgcagacctggaagctttttcatttccttaagatgattttgctcatcttccctctgatacattgtttgttgttgttgttgttttgttttgttttggttgtttttgagatggagtctcgctctatcaccgaggctggagtgcagtggtgcaatcttggctcactgcaacctccatctcctgggttcaagcggttctcctgcctcagcctcccaagcagctgggactacaggcacgtgccaccacgcccggctaattttttgtatttttagtagagatggggtttcaccatgttagccaggatggtctcgatctcctgacgtcatgatctgcccacctcagcctcccaaagtgctgggattataggcatgagccaacgcgcctggccgatacattgtttttaatggttaactttctcaaggaaactgtatgttcctcatgtcctccataccaagatgaagtcccattttgttccttaagaaatgaaaatacagtagttatgatcagtgactacaggcttgaggagaaaattcatccaggaggagataggttccaatctttttataagttggaacactagttgactttcttcctttttttcttccatcactggaaagttccatcatagtaacttctctattacagttcctacttttctcctttgctttcctctctagaaacaccactgtgtctttgtcttccctgagtagatgttggttcgttgagagacagtggcagataatccaagtgtctttaaatcagaagtctagtcaagtcctttgaactcccagataccccccaactggaatttgccttcctccagttgatttttaaaatctccttatttcttctggagatactgagtttctgctggtttacaagttatgaggtcactaaccagcctgtctcagccattgctagtaaagtacacttctacaattttttcataattgtgattattcattcgcactattttggttcttaatattccaggttttgcaactattacaattaataaagagatttataaaatagaaccctcaatgacacttttattcaaataaatatcgctattagaagagtggaagaaaattactaatttatatgtttagacaatgcttcactacttatgaaacattttttacattcattatcaattcacagggctattgccctgtgaaataagtacattatacctattttacagagaaaaatcaggcttagataatttcaatgcctgcaaacacatagccaggagttgtccccagacaagggctactgggactgtatttattgaaaatagaaatatatagtgattaccttgaagggcaattagatgttgttagttgttgtttttttttttttcccctcttccataccaaagggaaggcatagcagtgggttgattcctctagaaccttggtggtctaacattttagaaaactttcttctttttactgtacagccaagaatcctaatatgttccaaagaatgtattggtggattaagatgacagtaatgcttctaggaggagatggaagtagtatgggccacttgtagcctgtacactgtctttgtgggaattacaaggtggctctccttcttctggaaagatgcagtctactccagatggtgccttggtggcatagtgcaagttggtttcagtgctgtggtacatttgtgcaaggcattgttgtaagtgacagacctgtggctatcagcctcctgacctctctaacatgagaacaggaagcccatactacaagatcaggcatctagatagtgcctgaaaaatcctgacacgaaagtcttttattttattttatttatttatttttcaagacggagtctcactctgtagcccaggctggagtgtagtggcatgatctcggctcactgcaacctccgccttccaggttctagcagttctcctgccttagcctcccgagcagctgggattacaggttcctgccaccatgcccgtctaatttgtgtacttttagtagagatggggtttcgccatattggccaggctggtcttgaactcctgacctcaggtgatctgcctgcctcgtccttccaaagtgctaggattacaggcgtgagccactgcacacagcctacaaaagtgattttacttcaaagtttgaagtctgaagttttcctcttcattctaaattctctgtccttcttgggaatgattgcaacctcttcataagagtatgactccaaataacattgccacatcaaaagcctctgaggtcaaaatcaatacatgctggttccctccttcccttctccctttcctccttcccttcctccctctctccttccatccatccatccctccttttcttccatccctcagtatttgattctctactatgtgccacataatatagtagtgaaatagacagatgttgccctcatcctcacagagtttacatctagtggagaaacagaaaaaaacaaagtaattatggttcattgtgatgaatgtaatgacaaaggtaagctcaggatattatgagagtacacaggacgaatatctaaccccaacttggtagtcacggtggttttcttataagaagttacatctcagctgacaccaaaggataaataggagttttctgggcaaagaagtgtgtggatgggtagagttggaggaaggtgggaataagaggaaagagtggtcaagaatgagagaataccatgtgtaagatttggaggcaagaagtcacagtgccttggagaagctgtgtccatatggagcacatccttccattgtaatctcacttcctgagcttcctcttctactccctagtatccttggctttgtccatgggtcctaatttcaatccttatctttaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtaaagaaaaagtcacccagaagaatataagctttctttaaagtgtaaaccctttttcttactctactctaattcttaatgggagtttgggcaaggcaaagctggtggaagactttctaccatctcaattgtacttagctgtctctgagttcccttttcatcttctgatgactcttagggtttatatatactcctctgcattcatgttagagggaagagcctgactggggaaggaagggctaccccagagatgctgcacataattcttccatcttgctctgctgggctgccctaagaacagggatttggggccctgcttctccattatggcaatctaaaccaaccacagagagcagtcgcatgagtgatccaaatttcagcctgagccttggcaatcaccccgctaccaccaggtgggagggctccgtgtggacagtgtcctcagtcctgccagaagtcacaggttgggtgggtggacttgacagtgtatatgatttattcactcatttgttttgcattcaagttacaaataattgttttgaaaatatttcttacatatcttacttctctgagaacacagcagtgagttagggctcctgttctcatggatcttacattctacctggtagggtggtggagagacaggcaatacacaaagaagaaaaatatcagatcatgataagtattatacagagaattcaacagggtgatgagatagtgagtgagtgggtggttattttcaatgagttcagggaaggcctcttggggagtggacatttaagctgaactctgaatgatacaagcctgactgtaaaggagaaagccttgggaagggcagggaaagaacagcctgggaggtgggtacagtcaggcaagggctatgggacagaaacaagcttggaacaagcaaggatcagaaagaagatgggtgcggcaggagcagagtgggcaaagaggagagtggagggaggtgaatcccatcactgggcacctcaagttcttactaagtgacagccacaaagtagcagtgaggcctgatgtctgcagcaaacctgagccctctctcatggaagcgtatattgtttttcttttgcttttttcctggcaggtcaaaaatatgaagaataaagacaaacgtttaaagatcatgaatgagattcttagtggaatcaaggtgagaatctgagcgtaggtggctctctgtgggtaaggacagaagcagtggctctcttggcctttgcaaaccctggtagaggtgatggattcctgcttctgggccggttgtgtcacatgacttttgtttcatgtcctcctgtccctctcaggtcctccgttgaaccccaatttctatttattcaccctaaatagcttgttttgttttgacactttactgtagaagtgtttaaacatgtagaaaagtagagactatcatgaacccctacaaacttttcacccagctccaggaattatcagcatgacctaactagtttcatctataaacccacacccctcacacttgctagattattttaaagcaaatctcagagatcttgtcatttcattcataaatgctgtgtatgtagctctaaaagaaggatttattttaaaaatatagccacaataccagtatcatacctacaaaaaaaattaacattctttgataccatcaaagttctccagttgcctcatatgtgccttttgtttgttttgctgttggttagattgaataaggacccaaaaaatgtccatgcatgatatttaattgatagtgattttaatctactacagtctctctctctctgtctgtgtgtgtgtgtgtgtgtgtgtgtgtgtgtgtgtcttggtcattccaaaaaaactaggttatttgtcctatttcctgtatttcctgtaaattgatagttagatctaaaggtttgattgatttatatttgatttgggggcgggagtacaaggttgctttcaagtggtgctgtgtgcttcccaaactgcagcgatggtaacttgagcgggcccaggtgctgtcagcctgatccatcccttacaaggtttcctgctagtctttcactagagcagtggtttgtgatgctggcagcacattagaatcacctgagaaatttgaagtttgtaaaacccactgaggctgggagcctacttcaaaccattgaaattggactctgggagtgaggcccagacatgtgtatttttttaagttccctagatgattctaatatgccaccaaggtgaaaaacactattgtaagaattttatgatcattgcctaggtctgttatttcattaggaattgcaaaagagtgaaatttttaaattctgttattcccttgacattgattagctggaattttatgaagaagaattatctttcatcaacttgttggttaccctaaaatgaagtttgtatgggatagacagaaaaaatgcttgcttctttccctctatttgccagctttcatgataatgcatttcatcctccagaggtgaccaataagttcttttaactaaatattgttttgaattaatacatcttaacattatcctaaacttcttaaaaatgaaacagagcccccttttaactccttgttaattctccacacagagctctgacatgtccttctgtgaatgtggcaaaactaaaagagagagctggttttgaatctcagctctaccactgggtagcttaacttgccaaaagtttggcaaggttcccttgcctctctcaacttgtttccttatagtttaaatgaagataataactctacaaatgtaaggtgactaactcaactcaatttgcccagaactttttaagtcttaagactggaaggcctgtgtcctaggcagccctttagtcccaggcaaactggaacagttagtcatactaaggttgttataaagtgagataatgtatttaaaatgctttgtacatagtaggttgtcaacaaatacaagctacctttctgtaatcatactttataatctggatttctattccccacattttggggactatatcttaaaacatgggtggatcagatacacctggtgccctttcaggggcaatcatgtgagctgtattttttttcaacttattagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtgagtagcagaggggtccatgggctgcgtattcacctggacctgcatcagcttcctgaagaggaagttcacttttgatagactagctggcatctctaggcctgaccgcaagatccaggggacttgtccctctcaccgccccatgccacttttcctcctttgtaccatacccccagctctagtttcaccttcgtgtactgtacgatggtctggctcccagagcaacttttcaggatgcacagcaagaatgtggtatcaggaaggattggcttaggaggctttcttgtcttctttgggaggtggtgtaggtctatagtggaaggaacactgatataggatccaggagacctgagctctggtcctagtaatccattaattgactttgtgaccttggagaagatatttcctcctctcctgggctcagttttctcatctgtaacatggggaggctggatgatccttaaggcgccttcaactctgatatatggtgttcctgaaacttagcacaatgctgcttggtcccttttaggaataaattgctcatgaccttgccctttccaggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggtaggtcggcattctcactgctaactccctgtctctggttaaaagccttggagtccagaatgactggctatcacatcccatgtctaacttttgctggtaaactttcaagagagagatctgtttggtctctggagaccaatggtttgaccttaataaaatcatgagttttctgagccccagtttatctaactataaaatgaggataatcataccaatctcatctacctcacagggagacaatcttgtgaaagcatttagtgagattattatgtttagtcctagtactgggaacatttcccagcccagtttctctcatatttctccaaggctcttgaggtgttgagatagcattaggcaaatatggcccaaagggagaagagagaccctccctttgcataaacccatgtgttggtcaaaccaaatgcaaattgagagcctcaagctatcagaaaatgagtctggagttcaggaaaccttggatggaccagagggaatacctgggttctgaaaaactgagcatagtcactgatatgcgacaagtaccagatctgcagaggaaggtcaccggacaggcagcagactgatgagaaggcctgaatgacaggagtgtggtgacttgcatttatcccctaagtgtctggcttcagagagctcagaccatgggaaagagaaggcctccctgtcctggagggtgtaaagaaaagctggcagatttggcaggtaaagaagcaacaggatctttttagatacaatttattgcataaatagcaaaagcaagatcagcaaaggtatcagctccctgcattcctggtcctcaggatgacactgaatcaaaaagggtcagatggtggctgggctcacacctgtaatcccaacactttggaaggctgaggcaggcatatcacctgaggttaggagtttgagaccagcctggccaacatggtgaaaccccatctctactaaagaaacaaaaattagccaggcatggtggcacacacctgtagtcccagctactcgagaggctgaggcacgagaatcacttgaacctgggaggtggaggttgcagtgagccaagattgcacccttacactccagcctgggcgacagagtgagactccatctcaaaacaaaacaaaacgaatcaaaacaaaagggtcagatggcgatgcaatgtgagcagtggggtactctgtttttgaggagctgatccatgcagcagttaagtggttctatagcctgcttctgtaccctaaggagggaacaggcagaaagcctaagacttcatcagagcctgggtggcaatgaaaaaccatctcatgacagcctctttggaagagagggaagtaggtgagaaacatccttgtagaagtgcctcgaaatcttctcaagttctcaagttccagggactgcagggtattctgccaacacttacctcacctgccatttaagcttcggctatctggcctatgtggaagtgtgcagggtccccctgatgctatagccagttcctctttagaggctcccaggagtggcttagttaggatgctgggtgggcatcagggcatagacttagttaaataagagaaagccaggggcctagttaccagaaccagatagaagttaattttttgtcttagaaggcaggaggtagtttctggaattagggccgaagactggagagagacagcagaagagttgaactccatgagtttgctcaaggactgaaatagagcatccacttccatctgtctatggtgggatagcttccggggctgagttcggtggagattaggagatgccagctgtggcaaatagaaaatcatggactaacgacaaagtcaaaatctctctgcttgtgctcgttactgactttaattcttgagatcctttgtgtccttctctaggccagtgtttccacagagcggctagagaagtacttgggaggggatgacttggacacatctgccattcgacatgactgcaattttggtaaataaatttggaagttgcttcccaaacttattcgcagtactggtgccagaattttgataatacaagagcttagtagcagcaaactgagagagagtgtggagatttgtcttgagcctatgcttgcataagatacaaactgttcttacttgaattatgtttacacttagagcagattgctcaactagattgctaagtaaagctgggccagctcttctgaggataagcagggaatcctgcaaaagatccagaaagcagaagtcaggatagagccaagtgtgtgggattgggaaggtagcctggagtgaaagaatactcagattctgaaggtttaaagattgggggccagccatggccagagtgggcataggactggaatccatagtggggaggatttatatatggaggtggaattcatacaaggggactgggcaacagagggcctgagagtatacccagagtatccataggtcaggaatctgggctaccagtaggcttgggagttctgaataaaaaaggactttagccgggtgcggtggctcatgcctgtaatcccagcattttggaaggccgaggtgggtggatcacctgaggtcaggagttcgagacaagcctgaccaacatggagaaaccctgtctctactaaaaacacaaaattagctgagtgtggtggtgcatgcctgtaatcccagctactcaggaggctgaggcaggagaatcacttgaacctgggaggcagaggttgtggtgagctgagattgcgccattgcactccagcctaggcaacaagagtgaaactccatctcaaaaaaaaaaagaaaaggactttaggctggatgcagtgtctcatacctgtaatcctcaccctttgggaggctgagatgggcagattgcttgagtccaagagttcgagactagcctgggtgacatggtgaaaccctgtctctactaaaaatacaaaaattagcggggcatggtggtgcatgcctgtagtcccagctacctggaggctgaggtcggagaatctcttgagcccggaaagtcaaggcggcagtcagccaagattgcaccactgcactccatcctgggtgacaaagtgagaccatgactcaaaaaaaaaaaaaggacttcatatgcaggccacttctggtctcatggtctcattctaggagatttcattcacctcctgttagcgtaggagccagcacttagcagaaacaatcctaggagctgatggagaaagcggagagagacacgtgagggcagacagtcacgtggggacctacattggactaaaagagggctttttctcaacagacaaagccatgcagttttctgaggcctcctttacctgggaacatgattcggaagccacagtccgagagtgagttgccttctttccatcctaatgttctttagcattctcactgcctggcctattctcagaaaattccatgtaatagaatgcatggggaaatgagctatgtgcatgtcttcggttagatactagtgcaggataaacccctggagagatgagctgaaagcaaaggttctcagccccttcccctgataactgcatttgccatgctgctttcctactatggggccatgaatatccagctgtgatcccatgaagacatttgtgtgtgcagattgtggatggaggtagtgcagcgttggcaggtggccggcgtctctgggtatggtagaagacaaacccaagaacctgaattcagtataagttcattcattcaagaatagcaatcaggaacattggaatctggcttctcagtgtgtatcttctgcacatagtgtgtctcttaagcaccatgtgtaatagcacacccaattcatccactgagcacagcacacagagtacaccaggaggctgaataggccatatctttgtttcttcacaactgagcacatcttactgtctccttactatactcctgacttcccactcctctatcttgttcctacagcctttaacatggactccagagctagccccaggatgagttggggcaggagcacatgctctgaaccttcctaacccagcagtttccctttccagagaggaaactgggcagggcttccacttcactgttataggtctggaagaaattcacctcaatgcgcagattcagaaagactgtgaacaagttcctaatgttcctaatgttctagaaactcaaataacagggctggcacacacagtttccgggaacctatcccattgtgggcccctactcagccagatacagtcaaatatttaggagaagggccagggaatctactttcagcaaatgttccaggtgacacatttagtacctaatttgggaaatgttaatctagtccaatcccattagtaagaaaggaggggtccttagtccaaaggaagtgaccttccaagataacatagaccagcagtgtcagggttgggacttgaaccaagccaggtctccaggcccccactagggtcttgttcaatgggtaaccatgttagttctaggagaattttatcattggaaatgcacatttgtcacaaacagcttatagatgagttggataaattagggctcattagggctcattctctagccttttagagctaagaaaagaaaaagaaaaagtattaaagaagcactttggggtcttgtatatccaaggcaaattttccaatcttgaggggaaatctcctgataccagacttcatggagactcagagaagtgacttgaactactcttcaatacccaacccctgctatctccttcaaagacattcctgtctttcagtgtgaacctggacattatggcaggccaacttgtggctgtgataggccctgtcggctctgggaaatcctccttgatatcagccatgctgggagaaatggaaaatgtccacgggcacatcaccatcaaggtgagagggaatgccaatgcaaaagcctctgactcccgaatgtcagcagcttcgtgcttttgcctcactggggagaaggcactgagggctagtaggtgaggtcttggagacatccgatagatttgtggactgtgattctccttcccatttcagctttatataatcagttgctgggggtaagatttgggaatctgcatttttaatgagctctaaaggtgattctcatacgcatactacagtgtgaaaactgctgattagagaggtcttccttcaaaatataggcatttctggccaggcacggtggctcacgcctataatcccagcactttgagaggccgaggcaggcagatcacctgaggtcaggagttcgagaccagcctggtcaacatggtgaaactctgtctctactaaaaatacaaaattagccgggtgtggtggcatgtgcctgttatcccagctacttgggaggctgaggcatgagaatcacttgggcccaggagggctgcagtgagccaagatcatgccactgcactccagcctgagtgacagagagagactctgtctcaaaaaaaaaaaagtataggcatttctgctttatctatgtatttgtttctgaaaaatcatgcatcctgcaaaactgtacaataaaaataacaggacctaggggaaaagaattgtaatagatcactaaaaacttatataactttgtaaccaaactaccaacagaaacaataccaaccataacagtaatatcaagagcaataaaaacagtagattgtacaatcatcactggcatttgcacccaacattgcaattactcttgggcctttctcttcctcctttgagagctaaatctttgatggcatttgcttccaaaataaaaatctggtgtagggtgttgtcttcttcatcaattttgtatatatatatgtgtatgtgtatatacacatatatatacacacatatgtgtatatacacacatatgtgtgtatatatacacacatgtatgtatacacacgtatatatacacacatgtatgtatacacacatgtgtatatatacacacatgtgtatatatacacacatgtgtatatatgcacacacgtatgtatacacacgtatgtatacacacgtatgtatacacacacgtatgtatacacacatgtatatacacacgtatgtatacacacatgtatatatacacacgtatgtatacacacatgtatatatacacatatatacatatatgggtatatatacacacgtgtatatatgtgtgcatatatgtgtatacacacatatgtgtgtatatacatacacacatatgtgtgtatatacatacacacaaacatatatgtgtgtgtatgtgtatatatacatatatatacacatatacacacacatatgtgtatatacacatatacacacacatatgtgtatatacacatatacacacacatatgtgtatatacacatatacacacatatgtgtatatacacatatacacacacatatgtgtatatacacatatacacacacgtgtatatacacatatatgtgtatacatgtatatacacatatgtgtgtgtatgtgtatatgtatgtatatacacacacatatatgtgtgtgtatgtatatacacacacacatatgtgtgtgtgtatatatatattttgagacagagtctcactctgtcactcaggctggagtgcaatagcacaatttcagctcactgcaacctccacctcctgggttcaagcaattctcctgcctcagcctcccaaatagctgggattacaggtgtgtgccaccatgccccactaacttttttttttttttactttaagttccaggatacatttgcagaacgtgtaggtttgttacataggtgtacatgtgccatggtggtttgctgcacctattgacctgtcatctaggttccctcccctcgcccctcactccccaacaggccctggtgtgtgttgttcccttccctgtatccatgtgttctccctgttcaactcccagttataagtgagaacaagcagtgtttggttttctgttcctgtgttagtttgctgaggatgatgcttctagcttcatccatgtccctacaaaggacatgatctcgttcctttttatggctgcatagtattccatggtatatatgtaccacattttctttatccagtctatcattgatgatgcccggctaatttttgtacttttagtagaggcggggttttgccatgttggccaggctggtctcaaactcctggcctcaagtgatccatctgcctcagtctcccaaagtgctgggattatatgggtaagccactgggactggctaattatgcttttttttttaacggaggaaaatgttttcatggcatcttcatcagtactctgaacttttccagagagctaaatttagggaaaattatagttatttttgaattgttatcactacttgtaccaaacagaggagtatctatagattttcagctttttttcttaagatcttcatatatatattgctaagggtttctttttaagtatgagaatgcttcctccaattgatttatattgacctgcttgacaaaaaaatgtaagaaccagctgttctaccatatactgacatcatttcctgatttagcaatcactaatgaactaatctgcaatttaaaaaacatgcgctatagcagagcaggctacagatttaagtctgtcttctaactccttttgggaagcttttttcttgctaactcataactgggttcttcctcaaacacaggcctttgttggtctccatttctggtcttgtttttttttttttttttgagacggagtctcagtctgtcacccaggctggagtgcagtggcgtgatctcggctcactgcaacctccacctcctgggttcaagcaattctctgcctcagcctcccaagtagctgggattacaggcacatgccaccatgcccggctaatttttgtatttttagtagagacagggtttcaccatcttggccaggctggtcttgaactcctgacctcgtaatccacctgcctcagcctcccagtgtgctggaattacaggcgtgagccaccgcgcccggcctccatctctgttttttgtttgtttgtttgtttgtttgagatggagcctcactctgtctcccaggctggagtgcagtggcccaatctcagctcactgcagcctctgcctcctgggttcaagcgattctcctgcctcagcctcccgagtagctgggattacagacttgtgccaccaagcccagctactttttgtgtttttagcagagatggggttttgccatgttggccaggttggtcactcccgatctcaggtgatccgcccacttcggcctcccaaagtgctgggattacaagcgtgagccaccgcgcccagtttccatctctctttggttataatcttgcttcttaagatgtcatctataccatgggtccccaaccccgtgggcctcagactggtactgttccatggcctgttgggaaccaggctacacaggagaaggtgagcggcgagcgagcattatcacctgagctccacctcctgtcagatcagcagcagcattagattctcataggaccatgaaccctattgtgaactgcacatgccagggatctaggttgcatctactgcctgatgatctgaggtggaacagtttcatcccgaaaccatctcccaccaccaccccatctatggaaaaattgtcttccacaaaaccggtccctggtgccaaaaagttgaggaccgctgatctataccattcccttgtcagtgttagcctttcgttggtcctagtaaactcaattgggtttgactaaaaccctcttctagaagcatcacacacatttatcatctaattttcaggatcatggctgaaaaacgatagtccaacaaaagtggatggggcttttaatggtgaagaggatattgagtcctgagagtggaataactacaagcacgtgaatacatatcagatcctcagtcatcctgatgcacagttatttaaatttaagctccatttgtttcttcccctctccagccaccccgtccttcaaccctgcgtttctggaggtgcagctgtaacatgatctgatcctttttcatctagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaaggtacttgggataacaagggatcttcaagggtgaaggcatattgaagagaaaaagtgaggatggtggtgaagaactacacaggggtaatctagttgattaatttaggtagtcatatttggaataaacaccagaaatcatgtgtttgtactaagtggccacaatattccatgtaaataactcagaatttcaaactttctgcttggaaacagatacaggaattatgtaatttaaatcaaagatgatgaggcaaaggccatgagaagttaacagtgactggcccaaggttgatctcacaggtggtggggcagaagtgggaccagagcctaggtgtcctgattctacttctgtatcagtgaggccagaggaagattctactaatctgctttgaacacttagatgtttattgtgaattatcttttgatgttattaaaggcctttcctaaaaatagacttttagggttgggcacagtggctcacgcctataatcctagcactttgggaggccaaggtgggtggatcacctgaggtcaggagttcaagaccagctgaccaacaaggtgaaaccccatctcaactaaaaatacaaaaattagccgggtgtggtagcaggcgcctgtagtcccagctactcgggaggctgagacaggagaattgcttgaaccagggaggcagaagttgcagtgagctgagattgcgccactgcactccagcctaggagatggagcaagactccatctcaaaaaaaaaaagatttttaatgactgtattgtatttattatatagatctagcataatttattttgaaacctctaaataaagaccctgcatatttaggatgttttcatcctccctccccattactagaaataaatgtagcaatcttggggaacaaaaatcttgagatgttagaagattaatgaagatacagctctggagtaattttgttcattaattagcatacgcttattgagcacctactatgtgccaaacagtgttttaagttctggaattacatccatgaacaaaatagaaaaaacctctgctctacattgtcacagggtgacaagcaacaaaactattaaataagtaaattatctgataaaaagtggtaagttggccatatctaattattaggactaaagttatttatttgaatcagttctttatttgtataaaggaacttgtaagatttttaaccccttgacaccttattgagacaaatttcttccttttacccctccctattagattctgtgaaggtggatctagggagtagtgcttaatatgaattattttcttcttcagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaaggtgagaaatcattgaacatgatgaagatataaaggtggggtgggagggagaggggaggacatgtctggcaagtaagacagggaagatggtggacatatggtaatcaacacaacttcatattatttttatagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacaggtatgtaagaaggattgggacaagatagaacttgggccatgggtggaatggtaaatcaatatctaattcctgaactgctcagtatccagtgaactagatttggaagcaaactacccagagattcaaactctgctttctgggttctgtgtctctttgaggaaacatagaaattgaaactctatgcctgggccaaactggtgacttatcctgctcatctgatgtctgacacacaatcaaaggacactctttagaagggtacaactgaaagtctgagtgagtaacccttgtggaagaaacaccagtggcacaacggtccctcttttagggatgccatgttcctattgactctagtcacacatgtcatcccatctaccccaaatccattaaaaccacttcctcgacagcttcatgggctggcactattagtgtactgctaaattcttggtagatcctaacaaagggattttgattaatataccaaaaccactgggtgtttgaaccagaaaaaaattatggcagttgcgtagtctcagagtataccatagcaacagcctctaatatcaccaccattgggttcaccagttagccccagtcagcagtggagctctgtttactgtgacccttcccaaggacctgccaacagcagtcctgtgcattggtctggttatcaccctcaggtggttgtcaccagcaggagttcaggtcgagaaagccagggcagaaggctgtagaggcattccagaaatcagtcagatgagggagtagctacacagcctacaagtgacagcatgttctgaccatgaggtgaggacaagtaatggtttaaaaccaccctgggagggccaggcacgatggctcacgcctgtaatcccagcactttgggaggctgaggcgggtggatcacctgaggtcaggagttcgaggccagcctgaccaacatggagaaaccccgtctctactaaaaatacaaaattagctgggcatggtggcacatgcctgtaatcccagctgcttgggaggctgaggcaggagaattgcttgaacccaggaggcagaggttgcggtgagctgagatcgtgccattgcactccagcctgggcaacaagagtgaaactccatctcacacacacacacacacacaaaacacaacaacaacaagaaaaccaccctgagaagcccaagagtttgaaagaaaaatctaagccagggctggatgtggtggttcacacctgtaatcccagccctttggaggccaaggcggaaggatcactggagcccaggagtttgagaccaccctgggctatatagtgaaaccccatctctgctcaaaaaagacagaagaaaaatctaaatcaggaagtctgtagctttggaaggagaaggcgggaacaaagaacaggatggtgtaggtgacaggaattgggagccaggccaggagagtggggcaggagtatcagggaccagcagaaaggagcaattgaaagctttgcatcagcctttatgtgctccaggtagtagcgtggagaaaacaaaaagcacctgtgaaggggtgggttgcccctccacacctgtgggtgtttctcgtaaggtggaatgagagacttggaaaagaaaaagacacagagacaaagtatagagaaagaaataaggggacccggggaaccagcgtttagcatatggaggatcccgccagcctctgagttcccttagtatttattgatcattcgtgggtgtttctcgaagagggggatgtgtcagggtcacaagacaattgtggggagagggtcacaagacaattgtggggagagggtcagcagacaaacacgtgaacaaagttctttgcatcatagacaaggtaaaggattaagtgctgtgcttttagatatgcatacacataaacatctcaatgctttacaaagcagtattgctgcctgcttgtcccacctccagccctaaggcggtttttccctatctcagtagatggaacatacaatcgggttttataccgagacattccattgcccaggaacgggcaggagatagatgccttcctcttgtctcaactgcaagaggcatgccttcctctcatactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaacgagcatgctgccttcaagcatctgtttaacaaagcacatcttgcaccacccttaatccatttaaccctgagtttgacacagcacatgtttcagagagcacggggttgggggtaaggtcacagaatcttaaggcagaagaatttttcttagtacataacaaaatggagtctcccatgtctacttctttctacacagacacagtgacaatctgatctctcttgcttttccccacatttcccccttttcttttcgacaaaaccgccatcgtcatcatggcccgttctcgatggtcgctgtctcttcggagctgttgggtacacctgcagacatgtgataagtgaatctactgatgggactgacagtaggtacttctaccaaccaattttggactgcaggcattaaacatcctggtgctctccctaggcaaataggaggataacgatacccaatggaaatatttatcatcatcccttcttcctcaggtttggcagggcagcgatcatctgtggggccaggtacccatacgctatcattaacatatacttctataggattatccatccatgtgactgcccgaattaagggcgggaaaggcacataggcccagtaggtatagttagctgcagctgctcctgcaggcatagggagacttaccaccgttgatacaatcatcaaggctgcaagcagcatactctctggggtttgtgtcacctttgtgttctctagatattttgtagctaactgcgtcagcttctttagttgtgcccaagttggcggctctgccttcttggtggatggcaacttcatctgttcttctgacgtcaccattttgttcatcttgtgagtcaacggtgctcgactgtggtgtctccgtctccgcggaggtgcttttctttgcatctccgatgggttcattgtagaacttcaaatgtctagtgcgtatccaaacaggaagctgattttctcctggtgaaacacaagcaaaacctctcccccacgttatcaccttccctatttcccatgtcttatttttattatctttccaccaaattagttttccttcatgtgggctgttctttttaccagtaagatgttgttctgcagaagtagtagtctgatttctataaatgtttaaaaaatttaaagtatagagtgctagattaagttgcatctgaggagtggtacactccttactgtctcctgcttctttttgtttaactaattgagttttgagtgttctattagttctttcaactatggcctgtccttgggaattataaggcattcctgttgtatgtgaaattttccactgacttaagaatttttggaaagctttactacaatatcctggtccattgtcagttttgattttttccggaactcccattacagcaaaacaagacaataaatgtttttttaacatgggaagtactttctcctgtttggcaagttgcccatatgaaatgtgaataagtatcaactattacatgaacatatgataattttccaaatgaaggtacatgcgtgacatccatttgccataatgcattaggacacagacctctgggattaactcctgcctcttgagtgggcaggtgtaagacttgacactgggtgcaatgttgtacgatatcttttgcctgtttccatgtgacatcaaatttgttttttaatcctgctgcatttacatgagtcaaagcatgaagttcttgtgcttttatgaatgcagatgataccagtaagtcagcttgttcatttgctttagtcaaaggccctggtaaattactgtgtgctcgaatatgagtaatataaaatgggaaatttctttttcttacagtttattgtaataaattgaatagctggtttaactgatcatccatgctatatttaattagagctgtctcaacatcccttgtagcctgtactacatatgcagaatctgatataatattgataggttggtcaaaatcttgtaacactgtaatgactgcaaccaactctgctctttgagccgattgatgtggagttttgattactcgttccttcggccctgtgtaagctgcttttccattgctggaaccatcagtaaatactgttagagcattttctaaaggttcacgtctggtaattttaggtagaatccaagtagtcaattttaagaactggaagatctttgtttttgggtaatgattatcaataattcccacaaaattagcaagaccaatctgccatgcaccagaattgataaaggcttgtctaacttgttccttggttaaagggacaactattttgtctgggtcatttccacataattttattattcgtaatcttgtctgaccaattaatgtagctatttgatccaagtacaatgtaaaagtcttaactgtactgtgaggaaggaatgaccactccacaagatcagtattttgaataatgatgcctgttggagaatgtgcagtggcaaaaatcaaaagttggagtggggctaagggatctattctatttatttgcgctgactgaattttttcttccactaatttaatttcttttgttgcctctggggttaacattcttttactatttacgtctgagtctcctcttaagatagagaacaaatttgacatggcataagtaggaatgcctagagttggccgaatccaattaatatctcccagcaatttttgaaaataatttagtgtttttaatgtgtcttttcttatttttattttttgtggcttaatttttctattttctatctgcatccctaaataatgaaaaggagtagaggtttggatcttatcagatgctattgccagtcctgcattggcaacctctgcttgcagaaatgtataacagtcaattaatttatcttttgtttctgcagcacataaaatatcatcaatataatgaataatataacagtctgaaaacttgtctctaactggttgaagagctcgacctacaaaagtctgacaaatagttggactattaagcattccctgaggtaacactttccactgaaacctggtggctggttctttattatttatggctggtatagtaaaggcaaatttttcgcaatcctgctccgccagagggatggtaaaaaagcaatcctttagatcaattataattaaaggccagtcttttgggatcatggccagagagggcaacccgggttggagaggccccatgggttgaattacggcgtttacggcccttaagtcagttaacatacgccatttgcctgatttcttctgaattacaaacacaggagaattccaaggcgagaacgaaggctcaatgtgacccttttctaactgttcatttgctaataaatgtaaagcctccagtttttgttttggtagcggccactgatttacccacaccggtttttctgttttccaagttaatggtatgggtttaggaggctctacagtggctgcccctaacaaggataccctattccttctctttcttgatttattttagcctcaactggaactttaatgccatcttcattttttcctagtccctttcctggtatatatcccatcttggtcatgattttttgactcgtggggctatataatggagcgggcatgatttccgcaccccattgttgtaataaatctcgaccccacagattaagaggaattgaagtaatcattggctgaacagtactttcttgattatctggccctaagcaatgtaaaatctcagtactttgatacacttctgaggctgtgcctatgccgacaaatcctgtaacagccttttgtttaggccaattttttggccaccgatttaaagcaatgatagagacatctgctccagtgtctaccaacccttcaaactgttttccttgaataatggccttacacacaggtctgttctctgagacctgacttgcccaatatgcagcctttcctgtcggatcagtgcttccaaaccctcctgttctttttatttcactatttccacccttaatatatggcaggagtaataattcagcaatcctgtctcctggactggcactccaaggaattgaagagctaataaccaactgaatttcgcctttatagtctgaatcaaccacaccagtatgaatttgaactccttttagatttagacttgatcttcccaagattagtcctacagtcctctcaggcagtgggccatatacctctgtggggattttttgtgggggctcccctggaagcagagagactgcttgtatagtacataaatctactgctgcactgccgctcgtggcgggggacaattgttgtatcgtggtaactggcttattccctgaaacacttgggacagtgggtttgttgtccctgaaaaccctgaggaacaaatggctgaattgggaatgccccagtttgttgtggggcctgaggctggcccctttggtcgtttcccgacaatggttgcccatttttatcaaatttagaacgacattgactagcccaatgttttccttttttacatcttggacataagtcaggtggctctctacctgttgtagttgcttgaatagttatattctgtttatttgagactgggcaattcttttttaagtgaccaatttgaccacaattgtaacattttcctccaaatgttctaacttgtcctcctaaaacaactcctgttattgcttgagccataagcatagctttatgcatagctcctctgattccatcacaggcttttacatattctgagattacatctgatcctgcgggaacctttccttttaatggcttaatggctgattgacactcaggattggcgttttcatatgccatcaactccactatgaccttacgggctttttcattggcaattgacttttgagcaacatcttggagccttgccacaaaatcagggtagggctctttcgaaccttgtcttactgtattaaatgaggggcaggcgcttcctgggtcttggattttttcccaggctctaaggcagatagctctaacttgctcaatggcctcattttgcattaatgcttgttgactaatagtactccaattttgacttattcctaatagttgatctgcatctatgttaactggaggattggcagccctatttcttcggacctgttcttgtaccccatcaatccaccaagtcttaaattgtaaaaattgagagggtgagagagacgattttgccagaatctcccaatcataaggaatgagtctatgtccatgagcaatggaatctaataatgtcctcatataaggggatttgggtccatactgttttactccctctttcatatcttttagcatttttatcgaaaaagacttgtatctggcctcaactgtgagaggctctccctcttgggctccttctccaggtggcatcggttctaacgttactgggaattgccacgcctcagtatctccttcctttcttgatttatcaataatttcatgtaattcactaccctgtctactaggtggtgccgtaggattaagtctcctagtgggcggctgagggtatggcgccctgccctgtggtgctgggggcattcctggatatccatactgactttctgggggtggccgatactgaagttcggctggcggccagtattgataagctactggcggttgggtcttattttctttaacctgcgtttgaggttgtagtgttacgggcacctgacctgctggaagaggacttggccctcgtggcttagactctgatggccccactaattctggaccttttccttctaattttaacgtttcaggatatatcacctcctgtaattgattatagtcaacattttgcgttgactgagccattaccggctctgctacatattcgcaatgtaaactttccatttctttctgggattttttccttgtcttttcattacaatctactatacagcttctaggggcgtcaggaactgaaacgctatcttcttctgtttgaaatggttctaaagctgctttaataatggcccaatcattccatactataagtggaatgatattacccttcctacctgcttgttttagttccttaccaattcttttccagtcttttagatctaaagttccttgttctggaaaccatgggcaaaattgttctattatttgaaatagcttgattagatttttttgtagatactttaactccccctctttttaaaagaattttaataaagctgagataagaggcatatttacttttaattttacttttagtttgccccattattaccctagcttcttccgagctcacaagcttaccgtacggctgactgtatatgtactcgggatctctcgtcgacttgtgctcaatgaccacgctcgagcgtaccttcaccctagagaaaagcctccacgttgggcaccagatgaaggggtgggttgcccctccacacctgcctggaatggagggtgaagttcccaaggaaagaacagtgtctaatgctagagttctctgagttattgctcagtcaaccacatcaccatggttaccgtaagaaaattgggcagttttcccatactaatggtaaacatttttttctgattagcctggatctgagtttctggattctgttataaaccacttctcctttgaagaatcctgtctttaatgtacaaagaacagtttgcaaaacatccccgtaagccctttttctggtgaacactgagagaacatttctgagcagttttgtaagctccagagcctaggatgctgctgtgttggccctgggatctgggacttggtggaatgaagagaagggcaggagggcaaggtgagctgcactgagattggttctgtgtatgagtttcctaattagctgccttaacaacacatcacaaactgaatggccacacatttctggaggctagaagggcaaaatcaaggtgtcagcaggattagttctttcttaaggtgttaggcaataatctgttcaaggcctctcgcctagtttccggtggtttggtgatctttgttgttgctgtttgttgtggttgttcttcctatatgtttgtttcatttcctgaactaattctgttaagtctgtattctttgtcattgtcatgtgtgaccactgaagtctgtttggttggcttagtggtcagctagtgattagacagatactcccttaattgctttgaaacaataagtgtctcagcctttgctgagaggttctgtgtgtgtgttgtgggtggtggggagcatgtcttcagcactccagcaatttacatctctgccttagccttcacttcctgcttatacagagccacatagtcagccggaagtgaaagattagagccctcttccatctttcctggacatgtgcacagctctgcatgtgtaggtggcattctagattgctgggaatatatcagagagatcagagaccctgtgagcatcttattccccagcttttccttttaagtttttggtcagcttcttatttgccccaagtgttatcaccacctcaggcagctgctgtgatgttaaataattgctgctggttttttgagctagctcagtgttaggtcaaataggccctataaatgggggttttcagagaattccagataggtgagataatgtcagttctccagggatggggtttttgggagcattctgaacccactctgccccctccagtggctgctaggctgctggttttcatggctgctatgattgtatggctgttagttttctaggttatagcagccaaggagaggggggacagaaatagggtaagttaaactgccacaaaacttactgttcttactaagtttcagctcttcaaaaacacaaatgctcctgggattgttgcaagcctttggttaatttcagagctctgaaaaagttgactttgaccatttttaatcattattctaattgcttttatggaggagtagatatctggaggttcctattctaccatccccactgatgcccacactgtgtcttatattttattttattttattttccgggtatgtcttttaagtgatttaaattaatataagtttgttaaattatttgaatttcaagatgagcattttcttttctgttttgagagagtctcactctgttgcccaggctggagtacattggcacaatcatggctcaccttcaacctcctgtgttcaagtgatcctctcacctcagcctcccaagtagctgggaccacaggcatgcaccatcacaccctgctaatttttaaatttttgtagacatagagtttgcctatgttgcccaaggtggtctcaaactcctgggctgaagtgatcctcccaccttggcctcccaaagggctgggattacaggtgtgagccaccacgcctggccaagatgagcattttcaatttacaatcacttctttagtcaattctgagaatgtgactcttctatttgtctaccataatccttaaaagctctttcctcctccaaaggaacctgggcatttctaggaattttcttctccattttgaccattttctcttccagtggaatattaattcatctctcctttatcctgatatttcttaataacaagatgtactaataactatgtatggagtatttatggagtaaagtattccatgctgtatgtacatctgggatcccttgctgaaaccagcaagatcagaggaggcttctctctccttgttcataggactgacagggatctatgcagctctttccctaacctctactgtgtctccctagtccatgatggcagtgaagaagaagacgatgactatgggctgatatccagtgtggaagagatccccgaagatgcagcctccataaccatgagaagagagaacagctttcgtcgaacacttagccgcaggttggctatctattcagctggcagccctcgtcagctctatatttccacttgatctttttctttttcttcctgggcttttcctgtgagggttaacaccatggacactccaagctcttcctttgtttctttgttgtggggatggggaaagatcggggttgtgtcagtttcccctggtcatctgccctgaaatgcgctttgatgccagctgagtgactgtgacatctgcttgcaagaagacccttgggaattgcctgcatgctcagggaagcttccctctctcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaacaccacacagaaaagtagcatttgaggtgttataaggtttagaacccaaaatttttaacgttcagtgaaaattgaacgcatacttacaggagcaatatgtcctctgtcctttgcaaatcttcagactcattattaacctgttagcagaggctgtgggctttctaccaagtcatatttccataaagaatgctatgtttcctgtgaatgtcctcatcctacacttcatgagtgtttgattccattctgatgtgtggaggaacaggaaaactcagacctagagcacataattcaaattaatgaaatttaaccacaaatttcaaggtcggcagtagaaccccatcatctgttccactctgattttttgtttgtgtgtttattttagatacagggtctcactatgttgcccaggctggactaaaacctcagggctcaagagatcctcccacaccagccttctgagtagctgggactacaggggcatgctatcatgtctggcttgtcccaatctgtttttatatcttctcctcttaaatgcctttagctttgatgattatttaccctgcattgtatttcagcattgttctattatccttcctggcacagtgcagaaatggtgaccacagactaccaaattttgctacctgctacccatgctcccaggggactccacttctccttgtggttggcattctaggtgattccttatcaaaagccattagggagttctactaatattgaggtggggactttgcaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatgtctgatggctatgacatcttacagaatctgtctggaccctgtacttttcctggactcaggaatgcatttgccattatgtcctgggcacaagtcttcagggattcctgtgcatggtgctgacaaaactgcttccatctctaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgtaagtatctcaagaactgtcaggtggtgtgtttatatactgaggatctttctgatagggaggaattattatgtccccctagacaacactgttcagttccagttcttttgtcactcaacatgcaagtgtttcttgagtacctgctgtgagctcccaagaatcctggagattgagggatgaacatctctgacccttcaagtagctcagcatctagtgaagaagacaaccaaagaagtgaaggattataatagaatatagtaaaaccagtaacagcagtgtgtagaaaggtggtctgggagtacaaaggaaaaaaaggcactagcccagcctgcgtgataaaggtgggaaatgtcagaaaaggtgaaacttaagtcatagaagcaagccagggagatggcaagggttgggggatggcagtagagcagggtgagaaggattattctgcagaggaaggaacataaataaaagcactgtcacagcctgggacaggaaatacaagagatagtaggataaccctttgcttggcctctgcctccattcctgaaacttctatcttgaatgctttaagaatgagtaaatttggtctggactatggaatagagccatcagtgattttaaaaagttctcaaatattgtttccatctaccacagatcctggaccccttggcattcactcattcattcattcaacaaccgttattgagcactttctatgagccaactactgtactagacactggggcactcaatgaatgtgaagatcatagatgtctctcttccatgggccagacccaactcactgattttttagtgtatctgagatgggaattcaggaacagaggcagagatcaggcaattctgaatgataagtaactatcaccagcacagtttttagccctgtgcttatggagcagctctggactcttgtttgttggtcttggggcagacatagaaagtatagctcacagtccacagccaggttctggggacacagtaactgcttcaaaagtgggccattaactggtccccctgtgtcatcttcctctggggcagaaacagtgggcatgatgtcactagagacaacttcaatggcctttctgctctttactagaacctaaaagaacactcaattttgggtgagaaatttctcatagtaattttgtaaagatcacagttttccccatgttgtaatatatataatcttctgggaaagagaacacagaggttttctgtgagttacttaggcaacagtcatagtttgaagactgcttttgcatgagaaaggaaactgtcattaattatatagtatgtttcgttggggaggtggctcagacctattaaggggagtttgatcaaggggcctctgggatcaatggctgagttaagaggagatggagtggaggaaggaaagatggagactctgtgccaggtaaggatcaaaagtaatctgcatagaactgataactggtagggatttcttttctctgccaactgtgggtatagttatttgcattctgataggactttgggaaaggtaggttagactcaggagtcatccatgattcagagctttcctggaagaccattatccctgatacagtttgagaaattccagagataacttaaactcactttggtactcacatattaccaatcatagaatcaatataatccccacaaatttaggcaagggcaacccaaaatataaaccaagcttcttgagtgttctccaaaccatccatccattcattcatttttcttatttgttcatttatttcacatgacacgaaggcaacatggcagtaagacacatctgttcccgctgggttccttggttagaacactgtccaggcaggctcacattcaaccccagctcccttccccttggtcctctatgcttagcagaggaagcaacttcctgagtatttttagtagagatgggatttcaccatgttggtcaggctggtcttgaactcccgatctcaggtgatccacccgcctcggccttgcaaagtgctgggattacaggtgtgaccaccacgccaggcctaaatgaagaaattatggaaatgaaattggttattggggcaagcaatgcagcctattgcaaatgaacacaatgaaatgattacatgaaggagtactgggaacacacagaatccaacagattccttgctagaactaggaagatgtaaactatcttaggaagacctcagtgatggtgtatctctcctaatcgttttcctaggatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcaggtaggtttggaaatggctaagtcatccttccttcctctctatctataaaagcccagcctctttcctgagaatcttctctctgattcattgctagtcactcactcctcccctcagcagctttgccatttagtcatatgttgacatacccaggagcccacaggccactgtctgaagctgaagtgagagcatcaatgggtgcaccatttatggcaaatgtcaccctaactgctgcccacccttcactccctggaagcttaggtcggacagatttacgtttggatccaagactactttgagattggctctggacacagtcttgcagctccataagaacccccatgacgattaggtcggttccagaagagccatgctatggtgcttccttggttgactttggacaggcatagctgcttggagatgtctctcagcagcagctgggtctttctttttacttcggcaaagttctagtttcactggggtgtctgtgggtggtttaggctcaattccagtgtattcttcgagggaatgtgcagcttgaaagcaaaacagggaaactggaacgagtggaaggaaccctattcccacaataaaatggatgagggaaggggaggctgtggaggaactctggtcccaccagctgcttttgtggtgaattgtttgcctggggaaacaattctgaagacactgatcaggggctcgtggccttgtggcctgcgattggcggctcgcccccatgtccgtgtacagttcctcaggcacattgtcaccatagcggccttttaactattaataacaagccaacaaacaagaagcagggttattggagggaacatctgtatgtccatgtataacattttgcatcccgtctctccaacgccccactcttcccaggtttcaacaaatcctcacagaatctagtagcagcacggacccattccactcccccttgccctcaggccacagggttcttccctgcattggattctaccctgttccagttcttaccccctcagcactctgcatacctccagaattctctgtaccttcacacaccaccgaggcacagttttggtcacttaattgaacagattcttccctttttacccaaacctaggcatgcctttttctggccatttcctgcccatccccactttacacaccccacgggccccactgcctttacaaaatccttttggggaccttttctctaatgagtacagaaactgtcacatggatgatagccgtagatctgggggatatgggttaggctgacggaactccttaggaggtttggagactcaaagctctgaggctgcagtgtgctctcctcacgttcaccccactctgttccccaccaaccccagtcttctcattggtctcctcctcggagcctctcatcattctgctcccagacatggcactgcaggcttttgtcttgttcagacgtaagctgtgcccatcaaggggaagaatgctgggttgtggccagaaaggaggaagatggtggatgcctcatgactgcgggactggctgattctttactttttgtgtccagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggtgaggattgacaccaaccagaaatgtgtcttttcctggatcacctccaacaggtgaggcttcccctgggtatttacccatgtgtgtactttggggttctatatgtttgatattagcggtgggagggcaggcatggctagtggtgtgaaattcactctggccacacacactgtcatgctatgtaagtggagagaagaaagcatgagctttggagtcagagactgggtccccatgacagctctgccgtttaccaagctgggtgaattgccttgacttctctaaggagaatctccatttctttgtttttgtaatggccagaacacaccctatctcacagggttccacctgtctcatggtggaagtcaaatgacatttgtgagcattttgtaacccagtaccaaataagtgctgggtgaactgaacatcctctgtttacttttctgagaacggatgtgagattctccatagtcatgacactctttctgggtagtgaaggcagtggaggttggagagaggagagttgggaatttttaggtaagaccattgatgacagaaagggaagcttccgtcttgtgaacagggtgagcattattctccagtatccttaagccctggcaagcagtatgtcctggaaagaggaagatctttttcaggaagaaaaattcttgagtggcttccaaagtgtcttgaggcgctaaagatgctcagcattatttggaatgtggacaggtcaggagtttgattgtaaagatattttatttcttagagactttctaagaaggaaaaggcatataagtaaatcttattagaccttcactgtaaaggacatatcatatttattcatacacatgctggaattattggtgcagacatttaaatacattttctttgagaaagtcctttttttttttttttttgatggagtttccctcttgttgcccaggctggagtgcaatggtgcaatctcagctcacaacaacctctgcctcctgggttcaagcaattctcctgcctcagcctcccaagtagctgggattacaggcatgcaccaccacgcccagctaattttttttatttttagtagagacggggtttctccgtgttggtcaggctggtcttgaactcctgatctcaggtgatctgcccaccttggcctgccacagtgctgggattacagtcgtgagccaccacagctggcctgggaaagtccattcttttttttctttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccccgcggccttccgcagtgtttgtgtccctgattacttgagattagggattggtgatgactcttaacgagcatgctgccttcaagcatctgtttaacaaagcacatcttgcactgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaatgccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcaggggggctgaccccccccacctccctcccggacggggcggctggccgggcggggggctgaccccccaacctccctcccggacggggcggctggccgggcggggggctgacccccccacctccctcccggacggggcggctggccgggcagaggggctcctcacttcccagtaggggcggccaggcagaggcgcccctcacctcccggacggggcggctggccgggcaggggggccgaccccccccacctccctcccggacggggcggctggccgggcggggggccgacccccccacctccctcccggacggggcggctggccgggcggggggccgacccccccacctccctcccggacggggcggctggccgggcagaggggctcctcacttcccagtaggggcggccgggcagaggcgcccctcacctcccagacggggcggctggccgggcggagggctgagccccccatctccctcccggacggggtggctggccgggctgaggggctcctcacttcccagtaggggcggccgggcagaggcgcccctcacctcccggacggggcggctggccgggcggggggctgacccccccacctccctcccggatggcacggctggccgggcgggggggctgaccccccacctccctcccggacagggcggctggctgggcgggggggctgaccccccccacctccctcccggacggggcggctggccgggcggggggctgacccccccacctccctcccggacggggcggctggccgggcagaggggctcctcacttcccagtaggggcggccgggcagaggcgcccctcacctcccggacggggcggctggccgggcggggggccgaccccctcacctccctcccggacggggcggctggccgggcagaggggctcctcacttcccagtaggggcggccgggcagaggcgcccctcacctcccggacggggcggctggccgggcaggggggcagaccccccccccacctccctcccggacggggcggctggccgggcggggggccgacccccccacctccctcccggacggggcggctggccgggcggggggccaacccccccacctccctcccggacgggccggctggccgggcggggggccgacccccccacctccctcccggacggggcggctggccgggcagaggggctcctcacttcccagtaggggcggccgggcagaggcgcccctcacctcccggacagggcggctggctgggcgggggggctgacccccccccacctccctcccggacggggcggctggccgggcggggggctgacccccccacctccctcccggacggggtggctggccgggcgggggggctgaccccccacctccctcccggatggggcggctggccgggcggggggctgaccccccacctccctcccggatggggcggctggccgggcggggggctgacccccccccacctccctcccggacggggtggctgccgggcggagacgctcctcacttcccagatggggtggctgccgggcggagaggctccttacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggaggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcagccgggcagaggctgcaatctcggcactttgggaggccaaggcaggcggctgctccttgccctcgggccccgcggggcccgtccgctcctccagccgctgcctcccgggcggcgctcgccggcgcggcggcaaagactgagacagctccgctgcccgctgaactccatcctcccggcggtcgggcggcggcggctgcggtcggtcgcggcagcggctccgcttcatatctgcagctggggcccgcgggcgtcagcgccgcgactgtcctggctccgcactgccccgggccgcagcgcagccgcgccaaccaccagccgcggccaccatggccggacgggctccctaagccaccgaccccagcccgcggcgccttcgacccttctggggcctccggcgccgcgacctcctctgcctgaaatttcttttttcttttccttttattttattttattttttgagacggagtcttgctctgttgtctgggtggagtgcagtggtgcaatctcggctcactgcaacctctgcctcccaggttgaagcgattttcctgcctcagcctcagcctcctgagtagctgggactacaggtgtgcaccaccacgcccagctatttttgtttgtttgtttttagtagagaaggggtttcaccatgttggccaggatcatctcaatctcttgacctcatgatccgcccgcctcagcctcccaaagcgctgggattataggtgtgagccactgcgcccagccacctgtgagctttcttttcctcctccatctctggtcctgacccctcatcctcttaagcaaccctctcctagttccagaagctttcctgccagtgaggatggagataggaaatcagaaaacctaggggctccaggcatcctgaggtgtgaaccagagccctccagaccccctaggcctgtcacagtaaaagtccattcttataaactgtgtctatacacatgtattcttcagttctctatgaaaccccagtatatctccctgtggccaacttgcacctaacttcctttcaccctcagcttcttcttccccttttacaaatactgaaatcaaacagggcacgttgacccttcctatggtgcttactttttaatcttacacatggattcactatggcattgcttccccagcctgatcaaaagaagtcatttggagcgttcatttaaaatgcagatttttggccaggagcaatggctcatgcctgtaattccagcactttgggagactgaggcaagcagaacacgtgagcccaggagttcaagaccagcttgggcaacatgatgaaatcctggctctacaaaaaatacaaaaaaattagctgggtgtagtggtgtgcacctatagttccagctacttgggaggttgaggtaggaggatggcttgagcccgggaggtcgaggctgcagtgagccatgatcacgccactgcactctagccttggtgacagagcaagaccttgtctcataaaacaaaaacaaaaaaaaatgcagattcttgaatcccatcctaggccccctgaaatcagaatcttaaaggaaagggtccaggaattttccacatgaatttgtaacattgtatattaacagttgccctaggtgattcttatgatttggcgagtttggtagacattgcactgtaggattcccttagttcagcaaagacctctaggatctttaaaatgcaatttattttcttaaaaaatatatcaataggcttttaggaatacatggtgtttctaagtcaaattgaggcattgcctaagagtgcggcccgatcaagtcaaaccctctgagaatgttctgtgaacgccaaggttgctggttaagatgaggacgtgatcagtgacacgcactctctggttctgttgccccacaggtggcttgcaattcgcctggagctggttgggaacctgactgtcttcttttcagccttgatgatggttatttatagagataccctaagtggggacactgttggctttgttctgtccaatgcactcaatgtgagtttgaaggttgggagtttggtttcgttagtgtgcttattcttaaattaagcctgatgtatactgtggagtctgtgctcttgattccttcttaaacccagagggactaaagaagactgaggttcaaaccctggctccatcttttacccatggacgtattccttactcttcctaagtagacatgaatgccatctagaaaactggacataaatattgaccttagggcttaagaaggcaatttcatatgtttcaatctaattgttccctgtctgcctctttgcttggttctagtgagagaataaataactttcttctctagaacgtagcagtaatcagaaaggctttttgaacaaataattcctcctgtgtttatttttcttagatcgtagaataattggaggtaattctaataaagaacatagagtctgataaaactatagaatgtgtctcactgcagcatccccagcatgactagaggatacatggcaggcatgattcttttctagcacctaagacagtggctggcactaccgtaattattcaatcaatatttgttataaatgagtcatttgaccatctttttgaactaatttttttagttcaaagagatttgcatagttacatgtgggcattatataatagtgctgtcttcattagaagttaataaggcctgtggagcacagtggctgacacctgtaatcccagcactttgggaggccaaagtgggtggatcacctgaggtcaggagtttgagaccagcctggccaacatggtgaaaccccatctctactaaaaatacaaaaaaaattagccaggcatggtgatgagtgtctgtaatcccagctactggggaggctgaggcaggagaatcacttgaacccaggaggcagaggttgtagtgagccaagatcgtgccattgcactccagcctgggcaacagagcaagattccatctcaaaaaaaaaaaaaaagaagttaataaggcccaatgtgttcctgccagggcacctaaaaggactttgttattcactagagtcacttagttccttgtgtcactgccctttcatacccccatttctaggctttttagcccaggacagacaaggcaaatagtcaggaaactattagattgaaccaaaacaaaatgactcaaacaccggcaattacatatgcttcaatctacacaaagtggatactctgagtccccatgattccgtcctctgctttctgtggctccctttctttaaccaccatttgctcaacaagaactctctgtgcatatatgcaaactcctgagtctttttctgaaagaagtttgcatctgagtaatctacagattccctggcctggatcatgcctttccctgattcacaaagaacactaggcatccaggcaggaggcctgagctctgctcccactccacccattgccagactctcaaattccagctttagtcccaaaccactagacactcacattgcccttcgcgtgagcacctaattagtctgcagccattcaatgcactgctcttaattccttccccaaggaggcaaggattgtctttcttacacttttccttactcccttgtagagtccagcacagtgctgggtacaaagtcggcactggattgtccttgtggtttgagtggttgagttggtttctgtgcctatgatgattttcagtcttctggtttttctgtagatcacacaaaccctgaactggctggtgaggatgacatcagaaatagagaccaacattgtggctgttgagcgaataactgagtacacaaaagtggaaaatgaggtaaggaggaactggaaaaatccaggaacaaggcaaaaacaacatgcaactccttcgagagtgcatctttagaatttctccatattttacatgggcccataatgggtccctaaagtttcctttcctctaactcaaaggacctaatttcttcaaacttagaataggaaatggtttaggggatgtcgggtcttgcaacataccgaggagatctacagcacaagctcatggtgtatttttctttaactgaataaggtaggaactttccaaaagtgcaagtctagttcagcctattaaatgcagaggccattaggtagctgggacactgctacccttctcctgttctatgacacgagtcctgggtggactgttcggctgagttgccaccttataaaacttacttctcatcttgtctccttgccaggcaccctgggtgactgataagaggcctccgccagattggcccagcaaaggcaagatccagtttaacaactaccaagtgcggtaccgacctgagctggatctggtcctcagagggatcacttgtgacatcggtagcatggagaaggtaggtggagtgaaggaaggcctggatgggaggccttgtgatcaaacaacaattggacagagtggagagcagctgggccctaagccttcatcatttggatggagggaaagggtcagggcacttcctctgccctggggaggtgtggggacacagtatcagagggaaggatagcagccagggatcacacagacttaccgcagctgtcggggccttctgctcagctcctccctgcctcctagccagctgaccagggcccctttcctataaggtccacagtatgcagagaggaagtcaggaaggaaacaagggggcggccaggcctggtgaaggaactgttgagaatagcagtgtggaggttgtccctgaaggaagaatggcccagttctcctcccagtcttcaaagtcaggcaccctccttaggtgctgttgttctccgaggacttggggtctgatgagcaaggacgctgaggtccagatcagagtctggctctcagctggtggcagacctaatctttcccttcttcacttctaaacaagcatttttcttttttctttatttttatttatttatttatttattttcagatggagtctcactctatcacccaggctggagtgcagtggcacaatcttggctcactgcaacctctgcttcctgggttcaagtgatttttctgactcagactcccaagtagctgggactacaggtgcacgccaccatgtctggctaattttttttgtatttttagtagagacggggttttgccatattgaccaggctggtcttgaactcctgaactcaggtgatctgcctgccttggcctcccgaagtgctgggattataggcatgagccaccacgcctggcctaaacaaggattttgtttttatctataatttccaataataattataacaacagctgccaagagagtccatttcaaacagtgactatagttctcagcaaacaatgatttttggcatctttttctgacatctgggtacttttttcctcaccaaaaccaaaatcagtttaatatcttagagatggagtagccagtcactgcctcttacctcctgtgactgtgaatgcccaggctaaataacttttccccaagaattatttgtggaactaatgtgtaagggaactatattcgcagattggtgtggtgggcaggacaggagctggaaagtcatccctcacaaactgcctcttcagaatcttagaggctgccggtggtcagattatcattgatggagtagatattgcttccattgggctccacgacctccgagagaagctgaccatcatcccccaggtgagctctagaacttactcgggcacatgccgtggggagcagcttgttttacaggaaacatatgcagcttcttcttgatgtctgttcagtcagcactgtcaattccacggtctactcgggatacttgagctagttccctaggatggacacgtcatttccagaactttgaaatgtttggtaatatgcatttgtggctgcctgtatctgaccactaggtggcagcaacacaacagaagtcaagtacagcagacgattctttagcgttgctatagcccatcacggtttgcaagacttttgcaatcagcattagcagttttgccgctgaagcttgaagccattaagctttatactccccatttgctatggttaaaagatagaggagggaatttgctgcaggtttctgccagcaagcggaacgcttcgtgcatcagcaagaaagatttcccttcggcttcctctctggatcctgccagataaggactgccgcgaggcctctccgttccccgcagcggctcctcaggagaacctttcctcctccgcccactgcagcccagttcctctgggggtagttttggtctgtctggtgtttgctcagttcgatagtcttttctccagcctcttcaaaagcgtgacaccttcttctcatgcagctgtactattctttcctctaccctcctctgatccctctaccttgaaatcacgattatgggtttgggaggccgaggcaggtgaatcactggagcccaggagttcaagatcagcctaggcaacatggcaagaacccatctctacaaaaaatttaaaaaatcagccaggcatcgtggtgcgtgcctctggtcccagctactcgggaggctgaggtggaagcatcacttgagctaaggatgtcaaggctgcagtgagcggtgtttgtgccactgcactccagtctgggcaacagagtgaaagcctcaaaaacaaaaaataaaccgaggacttctaaccctgtgcctagcccctggctggtagccactccgagccttaggagggaaaaccttgcggaagctcaaccacaaaccagcttcctgcctcaggaatccatctcaggccagtcctatccaccatctcccagtcctgaggaactccgaggtccttttctggcatgagccccaacagcccccttgtcctttcacttgcaggaccccatcctgttctctggaagcctgaggatgaatctcgaccctttcaacaactactcagatgaggagatttggaaggccttggagctggctcacctcaagtcttttgtggccagcctgcaacttgggttatcccacgaagtgacagaggctggtggcaacctgaggtaatgttccatagcctgctacccctgcaggcaatgagaggatgtgagggggccactcctcgtgttcctcgtgttaggtgatgcctggcatagaattttcatccaggtctgattcctaaagtgtaaaatgaacctgttgtaaagttcacaagataaaatagatgtgaaagtgctttaaaactcttgaaaactggtcgagcacagtggctcacgcctgtgatcccagcactctgggaggctgaggcaggtagatcacctgaggtcaggagttcgtgaccagcctggtcaacatggtgaaaccctgtctctactaaaaatacaaaaagtagcctagcatggttgtgggcacctgtagtcccaagctactcaggaggctgaggcaggagaatcgcttaaacccaggaggtggaggttgcagtgagccgagattgcaccactgcactccagcctgggcaacagagcaagactccgtctaaaaaaaaaaaatcaactcttgaaaacctttgttattggccgggtgcagtggctcacgcctgtaatcccagcactttgggaggctgaggccggtggatcacgaggtcaggagttcaagaccagcctggccaagatggtgaaaccccgtctcactaaaaatacaaaaaattaactgggtgtggtggcaggcgcctgtaatctcagctactcaggaggctgaggcagagaattgcttgaacccgggaggcggaggttgtagtgagctgagatcacaccactgcactccagcctgggagacagagcaagactccatctcaaaacaaacaaacaaacaaacaaaaaacctttgttattaagtgtactcctcatatgacattacacaatgtgagcttacacatcccacagaaagcagaggctcccagctgtgcacaatcaggatgaaaatagtctggctgcctggtccaatcctagagtctgatttaattgtttgaggctagactggacatagggagttttaaaggatccccacgaggctgttaagggcatcgcagttaaagaaccactgatctaaagagcatgcggatgacagggaacgtgacatctgtaaaatccgtaggcactgttgaaacacctgaaatcaacaaaagactctcttggctttcacagttatttttaacctttccaaaacatttttatataattgacagttcacttctggccttcagtgtatgtttgcctgtccattaataagttgatctggcatttttcctgtaacatttttgtttttccttccacacactgaagttctgccctcagccaaagcccactgctcatggacaggtcttgctcctgccccaggggcctcagtggtggtaggcagggaataggccgttggcaagttgaagctcaggaaggaagggagggctcagtaactgattcaggggccagccactctggcttcacctgggagcttgttacatgtgcagaatctcagggcgtagacctactcatcagaatccgcactttagcaagattcccaggtgatttgtgtgcacattacacttgagaagcactgcctagagtgttgtgattaactaggctgcaagctaaaatcacccaggaagctttaaagctcccaacgcctaaactgtagcccagaccaactgaatcggggacccaggtgattttagtgtgtagccccagggaacaagccctggtagagaacatcgtcagtttactttccctccacaacagatctagcaactagcaggactcaagtaggtctttaggccagtgtaaaagatcattcaaacattcagtcagcaaaaatgtaataacaccggccgggcgcagtggctcatgcctgtaatcccagcactttgggaggccgaggcagccggatcacctgaggtcgggagctcgagaccagcctgaccaacgtggagacaccccatctctactaaacatacaaaattagtggggcatggtggcacaggcctgtaatcccagcagtaatccctcaggaggctgaggcaggagaatcgcttgaacccgggtggcggaggttgtggtgagctgagattgcgccattgcactccagcctgggagacaagagcgaaactccgtctcgaaaatatatgtacacctactgtgtgccaggtactgaaaatacagaggcaaacagagacacaaccctgacttcctagcatttacagcataatgaagacagacctctgtcagtaaatgccagtacagtctgtgctacagagggtacatttgggatgctatggtagggtacaatgggaggccttgacatttctggtttgtaaaaacaaaaatcatgccatctttctcctgtccaagctgagagatgcttaaatggtattaccaatgccttgatttcagacctgagtttcaaacctggcctgggggactaaaacttacatttctctgttgaatgatgggtaagttcagcttggagagagcagctgaaagacaaagtggcgcctcagcaacagtctgttactctaaagtccaaagtctacgttacactttgggccaggcaggagtttggtacaagctaagtaaatagtttttcagtgtctctgatcttacattacaggggaaaactggaagttcatcttgggtgacttctcatctcctgcagaaattttcttacagagaattacagcactttggccaccccctgtttaatatgttccctaatggccacagcaggaaagagcaattagcaaattcctgaatatttccttcacatcatttcccaaagcttctttatgttaggtaagaggtccagccttcattacaggcttttagcaaattaaagctatttgcattttagaagcatatttgaattccacatacattgcatctcacaccaagacatcacgttcattagacagcttcatctctaatcaaagcagaaggccttgaacaaataattagccttgaggctagaattacacattaaaataataaattgatttgctaaggccacaaagaaatgccactggggcattctagtgttgctccaccctatattaatggcttcaggtcaaatgctgctaacgtaaacttggtgacactcatgttgttttggaaatgttgatgtcacggcaaccaaatacaaagcatggttcctgggccattgttatccaaacttgtttaagcataaaaatggcctggggtgcttagtaaaaaggcaccttcctaggctcctgcccgctctgattgagcaaagcaagggcccagaaatatgactttttaattaagtacttggggtgggtcttcaattgggaaagtttgaaaaacgatgctcacagcagcaaggtacagctagttgaagaggcccaaacattccaggggaattttggagggggggttttgaaagtctgatctggaacatgaaaatggtccccctgccctgcgtctttccttggtctttaggagctaacacatggttgcttctattggctgcagcataggccagaggcagctgctgtgcctgggcagggctctgcttcggaaatccaagatcctggtcctggatgaggccactgctgcggtggatctagagacagacaacctcattcagacgaccatccaaaacgagttcgcccactgcacagtgatcaccatcgcccacaggctgcacaccatcatggacagtgacaagtgagtgtagggggacagggcttgacacggatggcttaacccttgctcaacagtaacagtgtcagccgggaaacacctgatggcagaaggtttaaccaccaccacattactgatgaagaaactgagacttagagatgtcaagtaatctggccaaaattttacatcacgcaaatgaaaacgaacaaggttaagggaactattcatatcttgagggcaaaataggaaactgtgtgttgtaacaattaactgggtatggggaggtggaagctcaagccgtgagaggcagatgttgaccatagaccttcctaactgtcctgagcctcagctgctgctctgtaaaacagccagaagctttctattccttccagctgtgtcatattacaatcaaaagtcagtaatcttagaaagctgtttggagatgataggcaccctttgtaaaccaatctatccttaaacaatgtgcacttcttttaaaaactcatgtaaatggactcatactgcctgtattcttctattacttgattcttttgttcaatattatttgcagaattcatccatgttgatgtgtgtagctgtggctcattgattttcactgctttgtagccttgtctgactataccacaacttagtcctggttattcttataaatgcctagacttgagatgctgctttctaagacttttatttctttcttccttgtttcagggtaatggtcctagacaacgggaagattatagagtgcggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaaaataaatgtcaccaggtacttgagaaacccctcgattgtctacctcgatcgtacttccttgctacccacccctcccagggacaaccactgtcctgaatttcacgataattattcctttgcctttcatttctgttttatcacctttgtatgtatctttaaacaacatatacccttttttacttatgtaaatggactgactcatactgcatacatcttctatgacttgattcttttgttcaatattatatctgagattcatccatggtgatgcaaataggtgcattattttttttcactgctctgtagtctggcattgtatgaatacagcacaatgtatcagttttaatattggggatcattagcattattctcaggtttttaaaaattataagcagtactactatggacattctggtctacatctcctggcacatatgtaagagtttctctagggtataacctaggaatggagggtatgaacatgtttacatgcacaaactagctgatgccaaactggtaatgccaactgaaaacattgctgtcaatctgatgaatatgaattgatgtatcaatgagaatttcatttgcatttccctagtatctattggggatgaatatattttcatgtttctggggcatttgcatttccacttgttttttaaatattgtgtctgataattccaatgtctggattctttgtttatctgttgtttctgttggtttttactcatggtattttatttccttgtatgtcttgtgaatttttattataagctcgttctccttaaaactttatctgtggacattctttgaggcctaagttgaccgtgaattcttcctaagggaattgggaatgctttagcctgctgcctggggcattacccagaacctctttgaatgaaattcttcactaaggggtttcaaaccacagtgcaacttcagaccacaatcctgtacaagagccagcttgtgatttacaaattctccagggaaagtgacaggttggagataggcatggggttttgttgttgttcttgttgactcctgcattctgcatggcaggacctaggcctctttacctgtacattgcaggtataaccctttcatgacacaggttcatcagagggttttagtctgcactgtggcagaccttggctttatctcttgccttgacctcctacattatcaacaaagtgagagtttaagatctcctgggcaggagatttcagaagccagcctaagttttgggccttcctcacctcctagggcctttgtgtcaggttcttttgggttcttcatattccttacctccctttcagtgatgttatgataaagattttgatttattcagcatttcacggtctgtttagtgaggtgcttaacattgaacttctgaaatgaagggcatatagctagtgtaagcatacctctggtttgccctgaatagttatgggttacatctgttttcccaaaacaataatagctccccctttcacacacgcacaaaaattgtctcatttgtatgataaacttgtgtgcctcctacacatagccctgtgaattcgattttgaatcacagcatggatggagatcaacaaagttgtatagatattgaagtgttggctgggggggcgctattcatggagaatcccctccttaattctgcaaaccagatctagtacattgtgaatattctataatcattggctattttttacagctagcttttcagatctatacctgcttatgtacatgaaatgtagctcctgtaaattgcagattagtgtatattaatctaagatgccatcaactgtaaaatacctgttattttctataccacgaagaaaggatactgccaattaaactttggtatgcattgttggtaaaatgcatcctatttgtggaaaaaaattagcattttaagattaatacaatacaatacctgtaaagctctataagagctaagtcatgtcctttatttctgctattgatccttgttcttttttcctgattgttccagtctgtattgctcttttaatccaatatcatcgtcatcatcatcagcatcatcatcatcatcatcacttcccttatctctttttctcaactatttcactgctaggtagctaactactgtttttaccatctattctttctaatcattagaatttcaaaaaactgctttttccttttttttagtggtgtttttaaaatttatttatttattttttagtgtttattttgaaagcacattccatacacgcgtactttccaacttgcttcttaaatgagtttttagatatagagcatttagaggggcaggaggaactttggaaaacaaaggaactatttacgctgactgcagaagccagagaaatgcaagctaggtaaagcaccaacagtaaaagtgaaactaaaggagaagcctgatattttctcaatttgtttctcaaacaaaatggtccaggctgatgtcgatatagttatcaccagagaactttgaagattatcagccatcacttatttatttagcttccagtaaatgtctgacactgtgccaaaaattttttaaaagctatctagggcgggtgctgtggctcacacctgtaatcccagcactttgggaggctgaggtgggtggatcacctgaggtcaggagttcgagaccagcctggccaacatgatgaaaccccgtctctactaaaaatacaaaaattagccaagcatggtggcacatgcctgtaatcacagctactctggaggctgaggcaggaaaatcacttgaacccgggaggcggaggttgtagtgagccgggatcacgccattgcactccagcctgagcaacagagcaagactccatctcaaaaaaaaaaaacaaaaacaaaagctacctaatataaactaaataaagattactttccattgtggcctaattaataaccctttcacaagctttatttcacttaccgatttcagggacaattttagataactacctaaaacctatacattcccaaattccaccatatcttcactgtttttcactgatcttttgggcactttctgtgcccttcccaattcttctgggtgcatggaatcatagtgttcagaagtaaaggtgcctatgcccatcgttaggctactatctctcagtttcaaacctacccttttagattttgctctgtgatgctgggacttataagtctcatttctgctttgccaactattcctattaagttctgacaataggaggtgctggagggacactggacgcagcctggatgaggaagaaaacgtgctccttctcgttggctctgttgctattagcatcactctaacagtttctctgcagcagcagttctcacaagtagccacattgattttagtttgcagtttttcaacattcacagaaagtgtcgtcaggcccaaaaccaacaccagctgagcagcgtcccctttttcagaagcaataaacagactgaaagaaaacaaactaattttacattgatacattggcacaaacaggaagaataagtctataaaaatataaagaataaacctataagaataaaccatcaggcctacatttctggcagaataattttgcataagcacttttggaaacatcctcagaataaatttgtcctgtttatataatagaatgagaatacatttaaccacaaatgcataccgatcatgaatttattttagaattagcaaacaatattgtacaaacattggtatttaaatctctaagctcctgcaacttagatttagttagcaaagactatattctactctgagtttggtcttccacatggactagacactagactggttttttgaaaggtttcatattgttcgaaaataccataagtaggccaggcacagtgactcacacctgcaatcccagcactttgggaggcctaggcaggccggaatgcttgagcgcaggagttcgagaccagcctgagcaacaaagtaagaccccgtttctataaataaataaaaaaaaatacagaaagttagccaggtgtagtagtgcatgcctgtagtcccagctactcaggaggctgaagtggaaggatcgcttgagcccaggaagtcgaggttgcagtgagctgagatcacaccactccattccagcctgggtgacagagtgggactctgtctccaaaaaaaaaaaaaagaaaacatcataagtaaaagattgtaaaaatgcataaaacaattggctgtaaaaagcactccattgtcatagccctccttttaatttcatatgcaagtagttagttatgctgtagaatttaactgttacaatataaaaagcaactatttatggaaaaagtagaaaaaaggagaaaatggccaggtgcagtggctcacacctgtaatcccaacactttgggaggctaggcaggaggatcatttgagctcaggagttcaagaccagactgggaatatatgtatggcagtgtttctttaaggtaaatgaacataaaaatagagtttcaggaagagaagaaaaactaggctagtttggttcttactgaattttgaaaatgaactacaatagagctccttcttcaattctaacaatcaaggccttggtcaccatattggtaatctcttgattaatcctcttgattctcacttgatttccatctggcgattatgcctgacaaacactatcacggatttcggatccatctgccctgttccttggcagccatctttgggacaattacttgctgctcaagcctggagaccagggttgtccaatcttttggcctccctgggccacactggaagaagaattgtcttgggccacatataaaatacactaacactaatgatagctgataagctaaaaaaaaaaaaatcgcaaaaaaaatctgattatgttttaagaaagtttacaaatttgtggtgggccacattgaaagccatgggccacatgcggcccacaggccatgggctggacaagcttgctatagacactcgttcttctctgggaaacaacttggttgtcagaagattgtggatagcactggttgtactattagctctggtcacaggtattgctcttgatacctggtgctaaacaatagctttgcctggctgcttcttttttagtgctcatctgcggacacctgtggtctggtttgtcagggtttgcattctggtaatataaaggtagcttctggtataataaatatttgcctggttgacacaattattaggtccaatctgtaaaccaattactctttggccagcttttcattgtccttaatccaacagtctaatttctctgcaaacttgactccaatgttaatggttgaacagaattcttttattttagttggacctagagtaggggtatggctctagggccaaatttgccctgctacctgtttttgcacataaagttttactggaacacatccatgctcctttgtttctttgccatctgtgcctgctttcatgttacaatacagagttgaggaattggcccacaaagcctaaaatatttactatctggccctttaagaacaggtttgctgaccactgctctagagccaccaatgtagcctggactgggtcacgattccatgctcaaaaagactatttgctggccgggcgcggtggctgacgcctgtaatcccagcactttgggaggctgaggtgggcggatcacctgaggtcaggagttcaagatcagcctgaccaacatggagaaaccccgcctctactaaaaatacaaaaaattagtcgggcatggtggtgcatgcctgtaactccagctactcgggaggctgaggcaggagaatcacttgaacccgggaggcggaggttgccgtgagctgagattgtgccattgcgctccagcctgggcaacaagagcaaaatctgtctcaaaaaaaaaacaaaacaaaactatttgcctttaaaatgtcatgtggcttcacacctgtgatagaataatggtcctcaaaaatgtccacatcctaatcctcaaagcctgtgaatatgccaccttccctggaaaaaaggactttcactgatgtgattaagttaagggtcttcagatggggagagcaccgtggattggccaggtgggctcaatgtaaacacagcgttcttataaaagaggcaggacagtcggagtgagagcgtgctgcgatgacggacggagtgagacagttgaaggtgccacgctgctggctttgaagatggagggagtggccgcaagccaggatatgcagaccttaggaatcggaaaaggtaaggaaatgaattctcccctggagcatccatgaggaaccagccctgccaacaccttgactttagcccggtgagactaattttgaattctgacctccagaatgctgagataaatttgttttcagccactaaatttgtggtaacttgttccagcaataggaaactaataaaagtaagcccaggtagctgtgataaaactgccacagttcttcagctaaagtcagtttaatgacaattcatggatcttcttcattaaatcccactgtagtttgagtatgtagagggtcatgctgccttttaagcccagctaaaagttggttgcaatactcgtgcctggcatcccttctatcaaattgcaaaaatcttattcagtttgaacagagttgcgggtattttcttggtctcaactgaaggctgtagtgagggctcttgtcaaagtgagtcctgtttttgacgacagcagattgagaatttctcaccctcagctttcctaattctggacctctggggtggttgctgtgagaaatgcttggtgagatgccgaggtgtggtggttcacaggcattgctgtgtgccgtggtcctgctccgtctaaggacctgtcagggtggctgcagggtctcacccacctgactgctccccagaaatgtttccagaatgaatacattgccgagactctaaccagaggcttgctcccttccaccaccaccccacagcctatcgctgggaaggcactaattctgcccctctctgcttgagggtcatctcttgagtgttaaggcgtaggtatccctatgtagcttgcaaaatctgcaacttgtggaaaactcctttcttgacatatgtaaaatactaatgctgacctgcaccaacaattgcagcaaagttctagcagaggctgtgggacataagccaggggctcagacagatcggagtccactgcccctgctctgaagcactgggtgatctgctacacatggcaaaggtaaaaccgtgaagacttcagcagtatcatgtaccaccaggcgggagagtttaatgccccgtgagttatgtggcgaccagagaggggatttagcatgaagtatttaaagctggaggtttctcggtcctcaagcataaggttctgcaaatgaaacacagttcagagcacaactgttaaggcccgtttgtactcctgaccctgaactaacaccctcatcaacagaatccaagcttcacaattaactaaaatggggtgacacaaaattcaatccttattgaaactgagctcctctggagctcacatttcatgaaagtttgtggacatcatctcactggattctcacatctcattggatctgttcctgagaggaagagatatctatacacaataatcagaggggaggccccatatctatgtttacacgataggttcccaccatcagtccctgtcgtgggactcgtggatgaaagcacaactgaagagctatttccagacagaaggggagaaaaatcaggaggtaagccagcaagctggatttaagaattttctttgacatttccttctagagtgtctgaaacatctgacaccctctccttccttggtttttgtaaattctgcttttctgacagcaaaaagtcctactttaaaaagttgtctaaacaggtgcttctcaaactttaatgtgcacacaagtcacctgaggatcttgttaaaatagactttgattcagtaatgctgtggaggtgggccccttgcagttccagcgagctcacaggtggtggcgatggcaatgctgccggcctagagaccacttttttttttttttaagaggtgggttcgggtagggctgggcacggtggctcacacctataatcccagcactttgggaggccaaggcaggcagatcacctgaggtcaggagttagagaccagcctaaccatcatggggaaaccctgtctctactgaaaatacaaaattagccaggcgtggtggcacatgcctgtaatcccagctactcgggaggctgagacaggagaattgcttgaatccgagaggcggaggttgcagtgagctgagatcacaccgttgcacttcagtctgagcaccaagagccaaactctgtctcaaaaaaaaaaaaaaaaaaagtgggttcttgctgttgcccaggctgggatgcagtagtgccatcatagctcactgcagcctcgaactcctgggctgaaggggatactcctgcctcagcctcccaagcaggtgggattaagggcttgagccacggtgcctggatctgcaggtcacattttaaggaggaagagcctagaagacatctggtatttaaaacaaaactcatctttttttttttaattatcaaaaatgatttctttgagatgaagtaactacatagattttgcagtactatggaatacttacatttaaagttgcaaacacaaagactcatcttgtaaacttgctcccgtcccagttatctcccttgtgcctgtgattccattattcagtttcatatttttgatagatgctgatttttttccattctcaatcttatgcccgaatcagttgatttcttttccccattcattggcttttcctgcctttggtctgttctccctccacagcagcctgttgctatttagcacttttttttttttttttttttgagatggagtcttactctgttgcccaggctggagtgcaatggcgtgatctcggctcactgcaagctccgccaccactacgcccaaataattttttgtatttttagtagagacggcgtttcaccatgttagccaggctggtctcgatctcctgaccccatgaccctcccacctcggcctcccaaagtgctgggattacaggcatgagccaccatgcctggctgctatttagctttcttaaaacaggtcatccccttaaaaacttatgggagttgattacctcactcctcaaattgaaattccttgatttggacctcaaacctctccaatgtattgtttgtgtcagacaatgttgtagcattctttttttaatggacccaaaaaatgtacatatttgtgtacatgttttaaaatacgtatgctgtaaaatggctaaattgagctaatcaacataggcacaccccatatgcttttcgttttttttgtagtgagaacacttaaaaatctcaacgatttttaggccaggcacggtggctgacacctgtaatcccagcactttgggaggccgaggtggatggatcgcttgaagtcaggagttcgagaccagcctggtcaatgtggtgaaaccctgtctctactaaaaatacaaaaaaattagccaggcatggtggcacatgcctgtagtcccagctattcgggatgctgaggcaggagaatggcttgaaccctgagggcagaggttgcagtgagccaagattgcaccattgcactccagcctgggccacagagcgaacctacgtctttttaaaaaaataaaaaataacagtgattattcaatataatacattaggtatagttgccatattgtttgataagtgtcttgaacttactcctgtctaactggaattttaaattctttgaccagcatctaccaacccctacctcactcccccagtgcatcgtaaccaccattctattctctgcttctgtgaattcatttttagattctgcatatatatgacatcacatgtttgtctctctgtgcgtcgcttttttttttttttttcttgagatagggtctcactccatcacc

SEQ ID NO: 1017 - DNA, 301595 bp, Homo sapiens
ttatgatcaactacacagttattcaaatttcactaattgtctcggttctgtccttattgcatgcttttggatccaggatcacacaatgcatttaattatcatgtcttttaagtttccatttaatctgaaacactttctaaacctttaatggtcattgtcattttcaaagcatacaggcaagttgttttatagagtgcccttaatttgggcttttctgttgatttgatccaggtttggcttttttggggggtgaggccagaaagaaaaacacagaaatggtgtcattgtcattgccttatacatcaagagacaagggtgtctactggtcctattattgatgttaactctggtcacctggttagggtgatgtctgccagattcttctactataaagatacaattcctctcttttttaattaatacaagaagatactttctgtccatgcaaatacattgttcccacccaaacactcaccctatattcatttaggagccaatgttgaattttgtctgaattatttatgacaatgatggcttccgcatgctgctctttgtgtcaatccttctatatttattagttgaaattctaaaagacctttcccttccatatgtccgtctatccatccatctacttagctacatatctacctatctacctaactatctatcatcttatcttatcttcctatctatcttcatctgtcttattagaatcagtatgaactcatgggttatttttaattaattatgttataagatgtaatttaaaaatcttcagtctgggccaggagccgtggttcatgcttctaatcttagcactttgggaggctgagaggggaggattgcttgatcccaggagtttgagaccagccagcctaggcaacatagtgagaccctgtctccacaaaaaatttaaaaataaaattagccaggcatggtagcatgtgcctgtagtcccagctactcaggaggcagaggtgggaggatcacctgagcccaggaggttgaggctacagtaagccatgattgtgccactgcattccagacggggagagagagtgagaccttatcttgaaaaaaaaaaaaaacaaaaccaaaaaccaaaaagaaaaaaaaaaccacctcaatcctttgttgattcttctttttactgaaaataatgtgatataaactctgtttcatagagactcattttattttactaatttaatttttcagacagtcttgctttgttgcccagactggagcgcagtagcacagtcttggctcactgcaacttctgcctcccgggttcaagcgattctctcacctcagcctctggagtaggagtagtagctgggattacaggtgtgtgctaccacacctggctaagttttgtatttttagtagagacggggtttcaccatattgcccaggctggtctcaaactcctgacctcaggtgatccgcccacctcggcctcccaaagtgttgggattacaagcatgaacccctgcacccagccttgactcattttaatttttctctaagtagtctgcaaaattttattttcaaaaggtttctcgtaatgccctccaaaatcaaatatgagtaacttttggatcaaacgccgttttgcaatacccaaggctttccatctattgctacggataatggtgcattggttgttttatgagcatgcttgctgagcaaaatactgaatttagccagaactttccagtgtaagctttctgtaaagtatctgtattttatctaagtttttatcttggtccttcttgaaaaaccatataatccctatgtggaccccccccctgtgataagtgagataaacctggagtgtaagtgaaggtcttttagggccagggtatgttatccttttattattttttagttctaagttcaaataaatatgtttctctcagccttcaatctacactgctgctttatttttgaaaagatgaggttattttctttagaacattacatttaaaaagcaaaacctcagttaacccacattctttctgtttttaaaggaaagtcaataccctgcatatcaacccgtgttcccccccacttttcttttttgagacagagtttcgctcttgttgccctggctggagtgcaatggtgcgatcttggctcactgcaacctccgcctccctggttcaagcaattctcctgcctcagcctcccaagtagctgggattacaggcgcaggaccccatgcctggctaattttgtatttttagtagagacggggtttctccatgttggtcaggctggtctcgaattcccgacctcaggtgatctgtctgcctcggtctcccaaagtgctgggattacaggcatgagccaccgcacccggccccatgttccccacttttacaagtggcctgatgtgtacccagctaccaccttcaacatcaagatcatgctgttaattcaagaatagacttggtgtaaacatatgcatagcatcgtttttaaaatacttttagactttacacatccctaattaacaatgagcaggattttggcttttaatgctattttagaatattgctaatgtatagtagagcatttggaaagtctgtgtagcctaattttaaacatgtaagtcatggtataatttttccctgattaataaagaggcttgtgtttactgagagctaattgcacaccaggcattgttctaaaatggtgcttctcaattatctggggttaagaataggttttatttaattattttaaattttcaatccattgcaaactaataagtagttctactgtgcatggctaatgtgctactcacaccacacatgcctcattatccaggttcaacaaactcttggctgctccacaaggagtcccccaatcatgagtttggatgtcatggcaaagtcaaaagcctataaaggtttctaatggctttcctgaaattcctgtacttattgtggcctgaggttacgaacagttcatggcctggcactagcccacagaccatgctttgagcgtcactgttgtagagtacgtccttcatatttcatcctcccaacagccctctgagaaaagtaccaccccaacctcaattttacagaaaaagaaatggaagcatagtgtgcttcccaacacaagggccaacaattaacaggtagtagaacttggactcaaacccaggcagccactcccactgcacagaggagccagcattcggacccaggaaggtggactccagagcttgggctccttctcgtgtgtgcttgtttcattttaactctatgtaaagtaagaacagttcggtttaggccatggtgaggacctcctgaaatacaccttctacagtttacaaacctaccttcatccacatttatcttactctcctctcatgatggaagaagggaccttcttactatacaaactcaatgcatttccctctaggtcctaacctttctgttctgttggatgctcttggtccaccaatcatcccaaccaaagcaactgtgcaagttcaggaactatgtccattttacagatgaagcagttgaggttcatagagacagaaacttatccaagcatgtaaccaaggatacatggctatagggtggccatatccccatttgtcaaggacagtcccaatttattgccctggcaccatggctggttagtgctttcttttcactctcaaaagtctccgacatcggacagcatatactttgatcacccaacattgctagggagtagctaagacagaattggctgccagatatatgggattgacccccaaactagggatctttctactaccccaggatactcccttaaatctcagaattacagtttaaaggaaggcttcttcccagtcattatccattcactcagcaaacatttatgagcacccacgatgtgacagacattgtgctagaagatgcagattttaaaatcaacagggcatggtccaagtcctcagaagctcatggtttagagaggaaacagaaccacaaatactcagggcagcatatataatttatagatcccagtgcaaaatacaaaagcagggccctttgtttaaaacttcagaatatctagatggcgaaaacagggcattaaactaagtgctgggtccttctaagcaggagtcctgcacactgcagaccccagctatgattcattgtaatgaggggtgctcagggtattatcgacatacataggagttagccaatccgaagactgctcgtaagatcacttcctggaataaatgaacacggctgattttagagaataaagacaacgaggatatttcccctgcatggaccttctcttctctttttcaggtcataggttgttgaagacaatcacttcatcagccatctcctgtcaactggcaattcattttgacttaaatgccaatcaccaggagtcttctgccactgaacacctcaataatctccctccagagctggaacatacactgtggtggacatggagatgtgccacccatcacccccttcaaggacttgtcccagcttctggaggtgtagttgctgggcaaccttctgctgtcaccccttttggggacagccctcatgcaatgactaatcaaggtggagggagaaagccctggccattggcacacaggacgaccctcatggaccattttagctccagggttcctggtgggatcagctggtctctctggctagcactccagctcaatttctccatccacccaatcctgcttcttccctcttcattccacaaggattaattccaagggtaactctgtaataaacatccggaacaccaaactccatctcagagtctgcatcccagataatcaaactgcagcacagaccaaagaagcttctagggcttggggaggatttttacttgaaaactgttagttatattcgtaagacttatttcttcccaacccccatctagcttctgcagaatcataacacttatttctaaatcctgaaatccgatataaaatagtggaaacaaggactctgtatgtgaatgaattaccctctgggttgaaaacttccatttgataaggatcaacatatccattaaaacacatataacatattttgtggaaattaaaccatgagtttattacaatttttgaggaaaactatttgtttttcaatctatatttggggaataatgtagtccataactatactatttatcaagtagggtggaagtatttcattgacacacatttactcaattttcaaagaatgaggatttgagaattagaccagttggtgaataagttgggttgagcatagacatggcttttaggatgagcattacttgttgaacattcttagttttctttatttcaggtgatagatttctctctttgcttttagtaaaataagtccattagtaatgcatatcacatttgtggaattataaagacattattttgagctgtgatggccagaatgtcatacagtcttctaggtaaaggcagatcttgaaaacgctctaaaacagaattggttgtgggaagtgacttacacattcattcaggtgcaaaatctaacatacttcagggcatacattaatcttttgagaacaggatttgaaacaaataccgagatttgagaagacaggcttctaaaatctccacagtcaaaccctctgaaagaaaaacacgaattttcattgcagtacataaggacaagttaatcagctgataaattaatattaactcaactcactaaattgaacaatactacataataaatctaattcactgactcattgaattgattaaagttgtttcttcacaagacatcaaccacttatagtgttattaataaaagcacttagcattatttcttctattgatacatagtatatatttttaaaattacatatttatgggatacatgtatttgttacatgcatagaatgtgtaattatcaagccagggcatttgagggtatctatcaccttcagtatttatcatttctatgtgctggtaacatttcaagtcctctcttctagttactttgaaatatataatgtattgttgctaactatagtcaccctaggctgctattaaacattagaacttctttcttctacttgtgttcatacccattaaccagcctccctctctcacccacccacccttcccagcctctggtatctatgattctattctctatttccaagagattaaatgttttagctccaatatgagagaatatgtggtatttgtctttttgttcctgccttatttcacttaacagaatgacctctagttccatccacattgctgcaaatgacatggttccattcttttttttatggctgaatagtattgcatggtacatatatgtacatcatataaaaaattatttcatccattgatggacacttaggttgatgccatatttttgctattgtgaatagtgctatgataaacgtaagagtgcaggtatccctttgatatactgatgaaagaaatatatgtttcttttcctttgggtaaatacacagttagtgagattgctggtttgtatggtacatcttttttttttttttttaagacagagtcttattctgttatccaggctggagtgcagtggcatgacctcggctcactgcagcctctgtctctcaggttcaagcaattctcctgcctcagcctgccgagtagctaggattacagattacaggcatgtgccacgatgtctggctaatttttatatttttaatagggatggggtttcaccatactggccaggctggtctcggactcctgacctcaggtgatttgtctgcctcagcctcccaaagagctcagattacaggcgtgagccaccgcgcccagccgtaaggacttctatttttaggtttgtttttttagaaatctctataccaggctggtcatggtggctcacgcctgtaatcccatcactttgggaggccaaggcaggtgaatcacctgaggtcaggagtttgagaccagcctggtcaacatggtgaaacctcatctctactaaaaatacaaaaattagctgggcatggtggtgggtgcctataatcccagctacttgggaggctgaggcaggagaatcgcttgaatccaggaggcggaggtcgcagtgggccgagatcatgccactgcactccagcctgggaaacagagtgagactccatctcaaaaaaaaaaaaaaaaaaaaaaaaagaaatctccatactattttccataggattctattaatttacattcccactaacagtatgtaaaagttccctcttttctgcattttcactaggatccgttatttattctcattttaataatagccattctaaccaggggaaggtgatatctcattgtggtgatatctcactgtggttttgatttgagtttcctggatggttagtgatgttgagcatttctcatatatttgttggacatttgtatgtcctcttttaagaaatgcctgttcatgtcatttccccactttttaatggaattatgtgggtcttttactattcagttgttgcagttcctcgtatattctaggtattagtcccttgttggatgaatactttgagaatattttctcccattcaacaggttgtctcttcactctgttgactgcttcctttgctgtgcagaagctttttagtttaatatagtcccatttgtctatttaaattgcctgtccttgaagtcttagccatacatctttgccgagaccaagtccctgaaattattttatttatgtacctcatctcctctaatggagattaaaaaatagaaaatgagcaggtggaaactttgaggtgatggacatgtttatgacatagaatgtggtgatggtttcataggtgatatttgtctccaaacacaaagcatacacattaaatatgtataactttctatatgccagtcatacctcagtagagtggttaaacaaatagaatccagaaaaaccttagagttccttatttttgtacttatcctaaaattgaagaggaagtgagatttattttatttattggttagagaaaatatagaccttggcttctcaggtaccaaaaccatcagacgcatcagctgtgatggaccacaaaagacaaccgtcaaagagcttcttattttaagaactcagcagaagtaatttcctacgtgtaaattattccctttttgaagactgaagcactgaatctgagattctaaaggaaaaacaagaccaactttttaaaaagttaactcagtgtgaagtatgacacataaaagtgttcaattaataacgatctaatcaccacccagccaaacaaaaattttttttttttttttttgagatggagtctcgctgtgtcgcccaggttggagtgtagtggctcgatctcggctcactgcaagctccgcctcccaggttcacgccattctcctgcctcaggctcccgagtagctgggactacaggcgcccgccaccatgcccggctaatattttgtatttttagtagagacggggtttcgccgtgttagccaggatggtctcgatctcctgacctcatgatctgcccgcctcggcctcccaaagtgctgggattacaggcatgagccaccatgcccagccacaaaaagtattttaagtatcgtagaagattcatgtgtatttcccctaattaccaacaccttccatctccccaaagttatgaactgttctggtgttgcactcctttgttcagctgtaacatttttgaattttatataaatgggatcataaataatcttttgggccaggtttctttggaataaatatcatgtctgtgaaactcatgagttcttcatgtagtcaattgctttcattgctgtagaagtattttaatacctcataatttgttttccttctgctgctgatgagtatttggattatctcgtttgggctgttaggaattatgtttctaggaacatccttgacaacatctcttggtgcacatgtgtacacatttggagtgctacagacagatcgcagagtgtgcagtttgagtcaatgctgtcaaattgttttccgaagatggtttttcaatgtacttacatggcagtacctgagaattcctgttgcttcattggcactgggttggtattctcagtctgttacattttacacattctagtgggtgtctagtggtatctcatggtgcttttaatttgcatttccctggtaactaataaagagtgagcacttttccagttattggccatttggatattctcttttgtgaaatacccattcaaatctcttgtccatttctctaattgggctttctgtgtttttcttaatgagttttaagagttctttaagtttatggtactggttctcagactttagcctgcatcagaatcacacttagggcgctcgcttcagtagcacatatactaaaattgtaatgatacagagattagcatggccccttaaaaaaagtcaccctatggcttgttaaaacacacattcctggcccccaccaccagagtttctgattcagtagatctgcggtgaggcacaaaaaggtgcatttctaacgagttcccaggtgatgcggtatgctgctggtccagggaccacactttgagaatcattatttaatagtgatttcagcgtaacagcggtagatgtttcttgttagttttggacaaagtcaccttaaaaaccaaaaccaaaagcaaaaacctcaaccatttaatactgctcaagcctgaggcataagctaatactctttcttcctagaatggtgcaaatggacttgcttaaatagcaactgcttcaaactgtctgaaacccactgaaatctacccgttagaatacttggtacacctaatttgccaagagaaccggttgatgatagaaggtatcctttgatactgtatttttcgatctcaggaaaactcactggcattcatcagcaagaacatgagtcaggaatcccttgaagcacagaaatacagatctctgaatggagatgaaaactatcatttatttcaattgaatttagtttcattaaaaaattctatgataacattaaaacagaaacaggacgtttatatgactgtctttaacctcaaaagtccaaataaacatatagacattttgaatatagctatcgttttaacaaacctcattatgatcactgatgcaatttcagtcacctaaaatacgaaccatgactattaataaacatttactgtgtgtggtttgttggactgaacattaaccatacgtgtatttctaagtactaggagttgaacagctactacggtcaatgtattttggcagttagctgtgtgtggtgtgtgctttttaaggcttcactcaataaaacatctgttgctctctgctgatgagcaaaaaacttgctatacgaaggacaaatatatgtatacaaacaaatgcacacgtgtgcatgtctatatacatatatgcaatttcagggaggtgacaccttattctgagaggtcatgagactccacttcaaaccataatagtaaaacctttagtaaactgaactcaacatattacagccaccatcatcaggaaaaattaaagactcatagttcaaataaagtacaaaaggtcccaggaagtattgtggtttgttgattcattcaacagaaagcccaaatgacaatgctattagtggtcaggagtaaactaacctggacaggctcatgaaaatgaacccctggatgcatcctgagaacgtactgcataattatagtcaatgcttgcaataattttcagtttgtctcatcacgttagcagagcctattcatgcaatttagaaaggatttcaatacagcccaaaccaaaaggcttacagtcaacagagggttagccttccataaatgagaaatccaaaaaagaataatgccacgtatttcaggaatgtcggttagaggtttggccttcttgggaagtgtcacaatgctgagtctaaaactgcaacagttaccgtgtccaagtcatgcaactctaaaggaggatggacggtcacatttgtgtccttcagtatcaaagcacctttaagggcttccattttgagaaagtagtattttctcttccttctcttttagaacatatgataaaatattgcccttctatcctttaaccatgtatccatttttttttttgatggggagtaaggggtacacactccctactacaatgtcacaaactttttctttttgttgttcctattggttgtaactgtactattttctaacaagaagccttcaggggaaataatggatcctagttatgtcaaagaaaacaatgagacaaaatggcaacttcacagtcttcaagtaaatagaatccctgatataaatggaaattaacatgtaattttgggggcaataaaaacaacaacaaaaacctgtgacaactttgtcctactcctttaaaaatgagctttgactctgtagtctcttaaggcacaaaacctgatagacggcatttaactggtggcctgcacctctgatttggattttaaaaaacaactattgacatttaaataaaaataaaccattttgttagagctggagatccttggataagttgggagaaatattcaaatgaactagcatcttgtatgtataaatatttgttgccaaagtaaaaaaaagtacaatgtggtttacatagtccaaaaactagtggaaaatgccttcggaacggacttgacattttggttggattcacagtgctgtctcgaaaatagttaaggtcgagggctgtccattggaagtgtttgtaaccatgtggtcagtgtgaccaatatgtggataatttcttttgaagtatacctagaaaaaaaaaaggtaagcataaaaagaatgtttcaaaattttaaagtctcctccctgaaacaatgcacttctgtgtctacttcttcatgtgaagcaaatcatatccctcactgaggcacaatttaagaacagggatgaatctactgtacagagaaattagccccactaaaaccctcagcagggctgggctgaatgccaaacaacctgtagatccattttagttccgatcactctgattcatagatatgttttatctctgtattaaattgataagcggaatcattttactgactcaaaacctggagataaattaaaaacagggtgacaaagaggctgggaaatctagcgtctgcatgagggtttctcattttcacacgtaaaatgagcacaatagatttggatgttaatatcaagttgtaatccctatattttataaactctgattgacaagcattgaaatgctggcatatacgtatgaaacatcccggcgtttaatttgtgcggcaaagcagttatagggcctatagaaatgtggtctgtggatagtggcccacaataatgaaaagagaagcaaaagctttaacaatgactcaaccaagcaacttctctaaaatgtaagatgataccaaataataggacagttctttgccaagcctttgagttcctgaattctaccaatttctagctgaactagaagagatacaggttttctgataaacgtataatcagaacataaaggaaatgaaatgctgtcaagtttctctgttccacaatcatcagtttttagtagctgtatcgtatcttggttccttgacagatgcgcataacaaaatgaaataatgtcaagacttgtgagctcttatctcaaaacgtgtttgggtgaaaaaggacttcaaatgtaattttttttccccaaagaagaatgtgaaaagttttgtttgaatctttaaaacagaaaatgtagcaactatctgaggctgacacgtgtcacctgggtctcttagtcatacgattctggatctattttataaaaccttgctctgaatatattggtgggtgctgtcaacaaagttatcactggagataatgggattcacgtacaaaaaagaaagtgctgagacacctgcctacatattaagtgtactttctttttctctcacttcttgcacacttgttactccagaaatatcattacatataacacacaatgtactaaaatgtcacttaaggagaaaataaattgtccaataatgctggaatgccaccagaagaaatctgaggctatttccattataatgcaagtgttcaaaagtaagacttttcaggggataatttcatatcatctccctctcccacttttttaagctagccatattttgtgtggttatagatttatgtactccaaaaaggctattctgtagtgaaactaaaaacagccaaaagaacaaatagacattcacatcactttctactgcttgatagccttccccaaataggctgcttccttctgtgtaaccctcttgatgtatttttttaaatatatataaagaaagtgttgttattagcaactttaaacccaaatggtcttagcttcatggtctgaaatacttagtcaaaaacaaacttcctgtgtatatattctttgatttgacctttctttttctcttctgctaccaggttttataacacactatgggtaacagcacaggtgagatgaaacatcttttttacagtgcaggtgatgaagggagttgagattactgaactacttttagcaaagccctcatgttgtaagctatgtctgggatagacaggtccagtctcagctctctcctggattcactgctgattctggaaaaattacctaaccactctctctaccagctgcctcatctgtaacatgagataacaatagcttacgtcacaggaactgattaatggctacaaactacaggttgaaaacctgctgcattagtgttgggtgtcatgatgaatgctgctcagagaagtggcccctaagcacacagaacgtggaggtatcgcccagctcgaaggatgaagacaaagcatttaggaatccctctggtgcatcttttatctttacagaatcccaaagctgtggctgagacaatttcaactgaatgaatatggtaacctgggaggcagaaaggtagaactgaaagatcatagaagatggagtatgaacacttttgaactggtggctttgaaaacttactcaggctgggcgtggtggctcacacctgtaatctcagcagtttgggaggccaaggcaggtggatcacttgaggtcaggagtttgagaccagcctggccaacatggtgaaaccccatctctacgaaaaatacaaaaattagccaggcatggtggtgcacgcttgtagtcccagctactcgggaggctgaggcaggagaatcacttgaacccaggaggcagagattgcagtgagccgagactgcaacactacactccagcctgggtgacagagtgagagactgtctcaaaaaaaaaaaaaaaaaaaaaagttactcagcttcttgtactttagcattttcatgtgtcaaaaggggataataacagcagttcagaaggactgtgaagcttaagggagacaatgccataagcgttcacgtttgcggcaagaagagtatcaggtcagtgagtatgggaaaccttgtccctcttttccttcttctcttgagtttgctccattatagttcctctaatgtaggttgaaactaagttcatatttaaactctaactcatcagtaaagccaccgtaacagagctagattttactaaaatcaacagagcaatacaagctcccgcacgtggacaaaggagagcaactgggctttgattgacattgcattcctaagataccatctgatgtgttgaattcaggctcaagaccctgtcagttcatttttactgatgtgtatggccctaattcaatcacagtaactctcaaggcctcaagttcatcatttttaaagccagtctaattttggtgtacataattggcatgcatattgtcaaagagtaatggagacttagaaaggacttctgcttttaatataatggagtaatgaatttcctctccttttcctttcagaaaccactctgaacatcaaagatattcattaataaaaaataagctaaatctttgtgaaatcaggagagcctgaatggtaaaatatcatgaagggctgccatatgcaactggaaccaatggggctgtggcaaggctgagaagatgtctatgaagagcaagcctcaacaatcataggaattctccagttaattggaggagcgctaaggtatgtcaataaagaatcaattagaaacatctttgactgacctatgtacattggtgaggtcctgacagaagacagattgcaattgcccaattctgtaagctaaggaggaagaaaggcaaaacatgcactctcaatttcacatacacacacacacccacacacacccacaccacacacccccacaccccccacacacccccacacacacccatacacacacacccacacacacacacacccccacacccccacacacacccccacacacacccacatacgcccaccccccacacacacccacacccacacacccatacacacacccacacccccacacacacccacaccccacacacaccctcccacccccacacacatacccccaccacacacccatacacacccacatcccctgacacccacacacacacccacacacccacacacccatacacatacacactcacatccctccctgcatcccccccaccacacacgcagcctctctgggtcataaagtacttctacattaagcacagaaaattccctttagccagaaacaaggccctagccacaactatcctgtaactatctggtctaggaagagttcgttttagtcataggtgaggagtaggaataataaaaattattattataattttaagagtagtacagggcctggagattatacaaataagaaatgaagtaagataaacacatgacaaatgttgagcacatagagtttatgaatataattcattcaaagaaaatgcagcagaatgatcaggctgtgcataacagagatacaaaaatacaggaaaacatggcagagcaacagaagatgctgaaacatgagttgacagtggtcaaaagtgaagtggaaaagaaaagtgaaaatatcaaagaaatgggctaggtgcaatggctcacacctgtaatcccagcactttgggaggctgaggtgggaggatcacttgagggccaggagttcgaggccagcctggccaacataatgaaaacttgtatcatataatgaacataatgaaatcttgtaaaactacaagaattagccaattgtgatggcgcacacctgtaatcccagctacttgggaggctgaagcatgagaattgcttgaaccgggagttggagggtgcagtgagccaagagcacgccactgcactccagtttgtggaatagacggagactctgtctcaaaaaagggaaaataaaaaataaaaaaataagtggcatttctactgaaggcagcacaaagattagccaatgctgaaaaaacagtgtgagacacaggataggattgagcaaacaaacaaaataactaaaagttaataaagaactaaaaaggattaaggagaaaatagctttacaaaatagacaaaggacataaaacatatacatgatagatatttgtaaagaagagaatataatcaaataaaaaaattcaaggatataattcaagtaaacttccagaaaaaaaagaaaacttgaatcaaagtctgaaagactgcacaataatgtcctaggaaaactaatgaccctttcagcatacaagaaaaaagatctggctgggcatagtggcacacatctgtaatcccagcactttgggaggccaaggtgggatgatggtttaagcccaggagttcaagaccagcatggaaaacacagtgagaccttgtctctatggggggaaaaaaaattagccaggtatggtggcatgtgcctctagttccagctttaagggaggctgagaagggagcattgcttgagcctgggaggttaaggctccagtgagctatgattgtgccactgcactccagcctggacaacagagcaagaccctgtctcaaaaaaaaaaaagaaaaagaaagaaagaaagaaaaaaggctgagttatgtcaaacatggtcatagatgtctccatatgaacagacaacacgagaagaccttagagcaaaggctgcaacatactaagtgaaagaaggtgtgacccaataattttatatccacaactttttaaaatttttatttttatgttaaattccaggataacatgtgcagaacgtgcaggtttgtcacataggtaaatgtgtgccatggtacagccaccacatttaaatcagaggggtaacaaagatttcagacatgcaataagtcagggattctaaattccaaggaacctttccctttgagatggtatagagcattgttttgcaactttttttttttaaactgccacccacaataatgggtggcacatttcactgtacacagggacttggtacgcatccactacctatatctgtatctatactgaaaagcatttcaaaaaatattaccattactatgaaagatacatgttatttttcttctattccattgtattctattttacatcttaaaacacactagtcatgatggaccaaattgattccacagcaccactagtgggttgtagcctgaggtttaaaaagcactgaaggataaactttagctaactaaaagatggagaaagtatcatttaaagaaaagccaaataacagaggcttaagtatatttggggtttgaaggcaaatagaagaaaaactaagctaaaatttggtggtaggatggagacagaagtgtatttatattgttattgtttataatggggagtcaagaaacagcatttagaggaaacaaaaggaacacatgcaaaacaatattcaaagaaacaaaaattatctactacaaattaaaaggtaaaaaggaatactaaaaactgaaagcataacatgacagaactaagacaaaacatacttataatctcaataaatgtaaatgtactaaaatcatctattaaaaacaaaggctaagattaaacctcagagtaaaacctaaccacgccatatacaggagacacacctttggatattcaaagacaatcccatatatagcagacaaagaaagcaaagtaaaagcacgcgacccagtctagttttgaaccagtgtggatttaggaccaaaaccattacacgaatcaaagaaaggtgtgttaaaatggcaggaaatataattcatagtggaaacccaagttatgaacatctgtggactgaaaaccatagcatcaaagttaccaaaacaaaaatgacaggtactacaaagagaaatatgtacagtgtgaaactaattcacctctagatccaagtcacagaaaatagaccaatataaataaggattaataagaatgtaattaacaaagtagaactaattaaaccttattaaactctataccttaaacagataacaccatcttttcaatgcccaaagaacatctagaaaaactaggacacaaagaaaattccaaatggatagaaaggatatggatgacatgcaatgaaaatgaaactgatgcgtaaaacagaaaagaaatgaacagaaaaaacaaaccgctaccaccaaaaagttttaaaaacttccctcttcaataatttctgggccagagaaaattaaaatccaaaattgcagaatgtataaataaaaaataaactatgagtgaaagcactacatatcaaaaccaacagaatacgaaaattcacagcgctaaaatactaaggaagaaagaatggacacaaatgcattcaagaagaagcaacgagaaaaaccaaaaaacaaaggtaataaagataaaagcagaaactgatcaactggaaaacagaatataaactagtaaataaatctggtaagtcattcaccaggaaaaaaacaaaaatagctaacttaattggaagttaattgggaaaagtgaaaagtacagagtggaaaaagtataaatactaggtagccattaaaaaatgaggtaactggccggtcatggtggctcacgcctgtaatcccagcactttgggaggccaaggtgggtgggttacctgaggtcagaagttcaagaccagcctggccaacatggtaaaaacccatctctactaaaaatacaaaaaaattagccaggcatggtggtgggcgcctgtaatcccagctactcaggaggctgaggcaggagaatcacttgatggagactgcagtgagctgagattgcaccatagaggtccagcctgggcaacaggagtgaaactgctttaaaaaaaatacatatatatatatatatatatatatatatatatatatatatatatatagagagagagagagagagagagagagagagagagagagagaaagagagagagagagagagagagaacgctaataaaaaatacacatataaaataaaatgaggtaactatatgtattgatataatatggaatataatattaagtgaaaaaccgtaaagaatagctattatttgtgctcaaaaaccagaaaagctatatatgcacagatgcttgtttatgcacagaatacatcaacaaagtggagaagaaggtgccagggctgaaacctggcagaggaactgcgtgatgaagggcaggtgtggcagagtgacttactttttacttattaaagttttttgcaaaactatcaatgctttgaattttgtaacatgagcatatatcatttggtaagctgattcttaaaaataatttgtaattatttagtctataaagctacaaaactttggatacttcttttgctattattgggagctaagagttcagtctacagtcttaaaaaagtactgagcttttataaccaatagctagaattcgcttatatttgtaaaacaccttatattctttgactcacttaaacatacactatctcatttaatacatgttaacagtgaagaaaccggagcagtactgcaatcctggcatgacaggtgaggcctctgaggctcacaggccttgggtgacttctgtaaggccattggctgctaagtgtctcctccacctattcaaacaggccccaggctcctaggatccaggatgtcaggacttcttgtctatctatccatccatccatccatccatccatccatccatccatccatatttttttgagacggagtcttgctctgccgcccaggctagagtgcagtcgtgtgacgtaggctcactgcaacctccatctcctgggttcaagtgattctccagcctcagcctcccgagtagctgagattacaagcatgcgccaccatgcctggctaatttttttatttttagtagagacagggtttcaccatgttggccaggctggtctcgaactcctgacttcaagtgatatacccgcctcaacttcctaaagtgctgggattacaggtgtgaaccaccacacctggccaggatttcataacttttgagttgtatctggcaatttcatgagtgcataaaatggcacctctgttactcactgggaacctcaaattaggtcggcttcatcagggaagacaatgattgaatttaccctgtgttatgggctgatttgcatccccctaaattcctatgttgaagtcctaacccccaagtacatcagaatgtgactgtatttggagaaagtctttaaaggtgtaattaagttaaaatgaggcctttagggtgggccctgatccaatatgactggtgtccttagagaaagaggtgatcaggacacagacatacacagagaaaagaccccgtgaacagaccccgtgaacatatagccatctgcaagccaaggagagaggcctcagaagaaagcagctctgctgacaccctgatctcagactccagcacggaagtgtgagaacataatctgctgtgggttaagccagctagtctgtgctactttgctatggcagcctgagcaaaccagtgcacccttcagctttatgtacctgaaatgtaattatgcaatttaaatttactttaaaatattaaaatactgagtcatctgcaaaggtcagtcaaaagagagactcagctttgcctgcaccagcattttcaggaaagcaactccgtggtcaagaatacgtgacttggaagtaccttttcccagatgttgagttttccttccaacaaatgaattctaatctgtgagagcgaaaagcttgttgatttagactaatcctcatggtgttacagttgtgaatgatgcattgatatttgatgcttgcacatttaaaaggttgacaatctgacagcttgttctcctaagaggaccaagtgtatgcagaaatgtcaagaaaatattcaacttggatgagaatcaagctgtgtatttccttatgtctttctgtagaggaggtgacctgagccagtggttaggcaggactaaaatccaggaaggaaattctgccactgtgtgaatttgggcgactagctgcatcttggataccaaatgagacaaggagcagcgttttcaggcttgacacagaacgctacttaggggaagacatcggcctcccccagcaatctaccttctgttctccacggaccagctctgtgtccacatgaagacacatgacccaacatcctcatcaatacagtaagacttacagactgctgtgaggattaagtagaatcatacatgtaagaactatgtaaacaatgtaaaataaattataaagaactatacgaacgtaagttacgattaatattgttgaattagatggaagattactggaccagtaattgagatttcaattctatgaccaatgtccctttctatatgtatgttatacttgcattaaacattgatttaaaaaaagattcctaattctgtctctgctataaattagtcagggcccacttacttcttggggccttagtttcctcatctgtaaaacaaaggtgaactatattatcttatgttagttggaacatgctaaaattctatgacctatttcttattactccatgccttgataatatataacatattttttaaataggtattttgatatatagatagggacacatctctttgatgtgaaatgcctgaggtaccaaagaacaaaaagggtttttgaggttcctggctcttttgtgactagattatacagggaatcccaaatgattgatcgggttttatgagggaagctttggctgggagacacgctagaagataaaagtattctgtaaatttcaagtataaaagaaatacagtgcttcaagtacagcttccctctttattcatacacaatgtgattcttatgaaaattcagaacacagatttttgtcgatcctaaagccaggcttgaatccggactctgcctataattctgctagctatgagatcatgggcaatttccttccctctctatgcctcagcctcttaaacaggcataatgagaagtgcacagtgcacatctgacacatatcatcatcatcatcattgccatcagggctcaccacatcaatcaaatctctgctctgctctattctttggcttatattgtcaatgactaggggcatgtttaatgtatttgttagtgcccagcgtaatactgtgcacacaaaggcatttatagaatcgttttgaggataaatgcaggattcaaagaaatatcctacagacagtggcaaggatagttcctcacttctgtggagaatgagatgaaataggagctgaaggcaacctaggttttatttggataaatctttaatacagaaataccattagatatgggaacatattttctttttcttttttcttttttttttttgagacgcagtttcgctctgttgccaggctggagtgcagtggcgccatctcagctcactgcaacctccgcctcccaggttcaagctattctcctgcctcagtctccctgagtagctgggactacagatgtgtgccaccacgcccagctaatttttgtatttttagtagagatggatttcaccatgttggccaggatggtctttatctcttgaccttgtgatccacccgcctcggcctcccaaacaaagtgctggggttacaggtgtgagccatcacgcctggtcttttttttttttttttttttttgagatggtgtctcgctctgtcgcccaggctggagtgcagtgtcatgatcttggctcactgcaacctccacctcccaggttcaagtgattttcctgcctcagtctcccgagtagctgggattacaggcaatcgccacttcacccagctgatttttatatttttagtagaaatggggtttcaccatgttggcccctattttcttattctgttgtctgtaatagatatttaaaatattacacacaaacaagcaattttattctacctacagtgatgaaaacctgaaaaatacagaaaacaatgaaggaaaattatacccatattatactgcctatggatgaacagttttgatgggagcctcaccatgtactgctagaagtctccttccaccctaagccaagaacattggatgttccttccctccctccatcaatacaactctcacctcacagaattttaaggaagaattacaggtgaccatgtgacatctggctaagtcccttaaatcaaactgcagttatcacatctgtagaatgagatacttccacatcaccattgttggaaagagatcacgtagcctgcgtgtctttaatgccttataaacatacttcaaggattattcaggctatagctataacatattataaattcttgatttgtcctgatggcaattacatctttttttttttttttttgagacggagtttcgctcttactgcccaggctggagtgcagtggcgtgatcttggcccaccgcaacctccgcctcctcggttcaagtgattcttctgcctagcctcctgagtagctggggttacaggcatgtgctaccactcccagctaatttttgtatttttagtagagacggggtttctccgtgttggtcaggctggtctcagactcccaacctcaggtgatctgcctgcttggcctcccaaagtgctgggattacaggcatgaaccaccacgcccagcctgacaactgcctcttatagaaggtggaggaagcatatgggctatatgggcctaattctaaacaacaaagaatgaggggaaaacccaggtcaacagtgagagtattatgtaacagttttctttacaaataataaaacagaaaccaaaagcaatctaggtagatctaggtagaacattttctaggtagatcattctagaacaataaacaatatcccacactttttgcccaaactcttaaatctcctgtatgtacctcaacagcatttgcctatcaataagaatgaaatgcaatgggtttgcagaatatgagtactatgtgctctatgcctttttctatgagaatctgaacccacagagtctaaatgtgtaaaaagtctggtctaacacctctccgcttcttgggcacacggcatgcacacatgtgtgcacacactcgaccccccaacccctacccgcttctgccaactctttgcagaccttacttcaacccgggacgtgccgttaagacccactcatgaagctttgtctctgcaggcttataattgaaaagggtacacagtgcttgttaccatacccatggtgccaaattgtgcggagggagccgctgagacaaactttaattacaactccttggagcacgctcacctgttttgctgtttcagtgagggcagcggcttctgccttgcccagttgttgcaccatcttgtaaaataggctctctttattttgcagcaaaacatacggctcatcatattctttcagtcttcctgaatctaaaacctgttaatcagcagaaagaaacccattgaaacacaatgttttgcagtaacatattataacagagacaatatttcggaaaggggcaggagagggagagaatctgtttgggtggtaggcctggatagtatttaaatggtttgattaccctgttttacgaagcaaacaaaggcctaacctgaccttttattactataatgttataggaaaggaagaaaatgaaagttctagactattattctgggcactcagcagtcctgtggcattttatattctgccaaaggcattttgggttcttatcattacttagtgcttttaactctcagactctcagccttgaggggtatttatacatatgatcagagttgggaaacttcttgatttaagaaagtcaaattaaatttatctaaaaggtagggtaatgtcataaaaatcagatgggagagacctgacagtaaattaattgccgagccagtttcatagactctaagcaatggaaaagaagtaaatgcttctggaatttctttaaggttctagaacatgtcagctgccaagaggggctaaactctggatggtgaggttaaggtgcattctgaaatcggctctgggtgtactttattattccgagagagaaaggctagccgaaaaagctgttacctaagcagctttagcataattgctctctgcacagaagaaatctctagaaatccaattttctctttggataagactaaagaaccaattaagaaattgagctccaaattcctgtgatcacagcccacatggcacacggggcagcccagtctgcattgctgagggctgaatatctgttttcccaatcacctttctttgcttctttctctttcttgagctgcttgccttttagctgctttattgctcattaatatgtccactggaaattgaaagagggaggaaggggctcttaactctgcatttctacttattagtggctttggttaatggtttcagagggaagaaagagtctgaacaattggcccaaatgacgtacctaggaaaacagttctgaggttaagtggcacttagttcttcagttaggccatatttagagtaaatttatcttaagagaatatgctgaacctccaagcaggacacaggttgtttttctacatgtagatattgcagttaattccgtcccatggtatttaatcggacacatttattaagcctcataaagggcattttcctgttaatcttttgtttactactgtgaatcactgctaagggcagctttctcaaaagagttcaagaataattgaatctgtcacatccacataacaattaaaatgtcctataatttggcatgccaatttagataccccaaatgtgtaattttacttaagcatagcattacagaacataaccactcctcctgacgaggaaggaaaaaatctgcaatttaaaaatacaggtctctctaatgctaaagactaagtaaataagtgaaccaaattacttgctaaaatgatgaagttttagtctgcaaaagcaacaagtaaacttttaaaaattattcccacagagttgagagtgagtgagttctctgtaaagactttacataatgtttaatggaaaggaagtcctactactatttggtccttgtccaaattcctactaaatttattcacatttgagtgactagtaaatctttccagattccctctcattgtctgaaaacacatgaatgccactgagaccaggagttctcaaaattgaccagaatctaaaaaggcagagccagaaaaaaaaaaataatgttctcaaaaagcattattattattagattaataataaaaatgacagaaagatcatttggtcaaaatactttaagccttataaatatcaacaacttagcaactgcattttatttgttaggagagtttttgagtttaggggtgatagaaccatgaccttaataatttactagaacttaaaattttaacttctataaggtttcacacttaaaaaatataaaataaaaccgacctctttaatatttttttgatatgcattaaaacaaaatataggccaggttcagtggctcacgcctataatcctagcactttgggaggccaaggcaggtggatcacttgaggccaggagtttgaaaccagcctggccaacatgacaaaaccccacctttactaaaaatacaaaaattagctgggcatggtggtgtgcaactgtagtcccagctacccaggaggctaaggcacgagaatcacttgaacccaggaggtggaggatgcagtgagccaagatcatgccactgcactccagcctgggcaacagagtgagactctgtgtccaaaaaaaaaaaaaaaaaaccccaaaatcccaaataaccccccaaatatagtatcttataatgaactggattattatagctgcagatgaatctgcaagatttgagacaaggcatccttggcatataaatatgacctaacaaagagtatggctaccataaaaatcaatgaaagcaccccataactaaaatatcagtttgtgaacttgaaaaggaaaataaaatgggttgaacatgctctgcttttacagtcatcccagaaaactcccaaaatagaatggataaggtaatttccttccttccatccattcatccaatattgagtgaatgtctatttccaaagtatcattttaggaatgggagattcaaagatgagcaagaaacagtctatcaagatgctgacagccagagataaagatggaagtgcaaataagttaaacaacttagcctaggctgcacaaatcggaagatggcagagctgggatttgaacccgggtgtaaacctgtcttctttcctcttcatgtgagttcccagaggtacattattatttactttcagtttctttgttttcagaagtaaaatatgggcaatgagaactgtaaacagctaattttctaagacaccttttcatttggataataactgcatattttaagaaaaatatgcctgtaagcataaaaaagttcacctattcactttccactacaatttgagtcctattacacccaggactcaaaattatttactgtgtgcctggcatatactcacagaaaaagaagacaaattttttgttgttgttgttgaaatagagtctcactctgttacccagactggagtgcagtggtgtggtctcggttcactgcaacctccacctcctggactcaagcctcagcctcccaagtagctgggactacaggtgcacgccgccaaagcctggctaatttttgtttctttgtagagatggggtttcgctatgttgcccatgctggttttaaactcctgagctcaaagcgatcctcccaccttggcttcccaaagtgctgggattacaggcatgagcccccacatatggcccaagaaaacaaacttcattaaagtttcaggattaataatgagcaagtgacactctgccaaaacacattggaggaaaatggaagtgaaccttcatgaattcctgaatttattcagcacacatttattgcacacttactgcattcatgtcattatgctagatgctgtggaagaggcaaagatgggtaagtcccagcccctgcttttaggaagcccatactcaaaaaaaaaaaaaaaaaaaaagacagaagaaaacactcaagtgactagaatgccagaaaaaaggcaaaacaagcgggagtttagcagcagcagaagtcacctctggccaaaatttctgaggaggagcttcagggaggagaaaatagcaaactgggccttgaggaatggacagacttagacacgtagaaatggtggtggaggtgaggggtgggaggaccgtggtcattccagatgccgagaggtctgacagctcacctatcacttcctcaagggcagggttatgtgcttgctcttgttcactgttgcatctccatggcctggcattgcacatgacgtgtgagcaggcaccccatgcacactgcctaaaagttaaatacaaaggaagggaaattcagggcacaattgggtgactgaccagtggtgcagtctggtaagaccacagagtgagatccagcagagaaagagtctagctggccctggaaaacagatatggaaggaggtatagggatgctaggattcaggctatagccttggaggaccacatgcctcaagttgatggctatagacaagagagagaaaaagcaaaaaggagacacagcaggaatgagggcagaggcttgactcacaaattaaatattggaaaagagaaaataaggaacaatctgatgctacaagggccaagttaggatgcacatgaaaaaatgctaagaatagaactttacccacttagcctttatgcatgttgagtatacttaggaaatgcctgggaccagaagtgtttcagatttcagatacttttgaattttgcaatgtttgcattatacatacttacagattcagcatacttaatccgaaaatccaaaatctgaaatgccccaatgagtgtctcctacaagcttcacatcagagctcaaaaagtttcagatttaggagcatttcagatttcagattaggggactcaatctgtatttactgatttgaccaaagattctagatcttttacaacaaaataaagtgactctgaattttctttttgtacagaaaaaagggcataatcttgaatttgtatcttcatatcttctgtagctacatgaaaacagtcctgaaatctcctgcttggtcctcacctttcctctacccaagtaaaactgtaaactaagccatgcattgatgttggtcccgtggccccaggatctctccagcaatgcaaacctcaaatcacttgctgctctctagaaggtcaaggaaaaacacattatactggaatgcattagtcagttactcagttacataagctcaatgaagatgtgtttatcaggcctaaatatctgcagatattccaggtagctgtcctagatataaaaattaagtgaacaaactgcaaaacaatttaatccatttaattggcaggatgccatcgctgatagtggggtgatctcaggaacaggggaagggcagggcagggtgaaggataaagcctgaccataggaaaagaaaagctcggaacagctttcactatggcagcaagcaatacagagaaaccccacttagcaacaggcagagtgagggtgggagggtttccatttcagaagtcgtttctgggccaccatgatgaaaggggtgtacggagagtcatctgacgttggagattggttccctcactggtaaaatgggtgcctgtgactcttctctgggacaagatactatggcatgtggcaaagattacttaaaatcctgcctcaggtcttgaaacagtaaatgattcttctcacctggggaagatgaagggtaggtcccagtgacccactcagccacttccccaaagctctgcaattgtgtgtatttattctcccagtgtgttcattttttattttttgagatggatctcactctgtcgcccaggctggagtgcagtggcgcgatctcggctcactgcaacctccgcctcccaggttcaaaagcgtctcctgcctcagcctcccgagtagctgggattacaggcacacggcaccacgcccagctaatttttctgtatttttagtagagacagggtttcaccatgttggccaggctggtctcaaacttctgacctctcaggtgatctgcccttctcggcctcccaaagtgctgggattacaggcatgagccaccgcgcccagccccagtttgtgctttctaccttcacattagttctttgtccccctgaacactttaattaaatgtctcagcatatttttcaagaagtaatttttcctcttctgaaatgttctaattgtggccgttgtcggtttcttaaagagaagttccatgaagatgaaacatagaatttaaataaaactcaggttagctttgagttgtgtttctccagctggttctgctagaacgatttctagtttgttttctctgaggaaacgctactaaaaagagatttgggtttagaaagaaagatatacattatacacccataagattgcctacaaagaaaagagctacaatctgaatttctcaggcctggttttgcttctctgtaattcactcccgaagaattctctaactgcagattcgcttattcctcgttcactcacactaccagggagaatccagagcgttgtaaggacgggtgtgcagggactggaggaaaaggctgtgctattggctgaaaggaaaacaggtcacaagtaaccagctaatcctaaaaactacagggaggaagctgtctttaatgtggagatagtggtgcgtattagaaaaaagaggatttctaatttgtctgtcttgctctactgttttgtggcaactgagcaaatgaagattaaattagctgtcattaagactacaccatgtttaataaagttaaaactgggagaacatcttcataaaataaaattctaagcttaacacattgatggcgcttaatgaaccaaaactgggtaaatccctttggagagtcaacacataaacaaagctattaattaggtcgcagttgtttcccaacaagctttttgtttgatttacttacagtaaacaaaactatatctatccgtctttgtggagaagtattcaccaatgcaacaaaacgtaattattacaccttaagcacttgcaattacaggactgcatgatgacaatagtgttggttatgtccttcattaacatctgtcacttccccagccactccctgagcctgccttttggagtgctgagctttgcagctgattcacttgtctctatgttttcacagctttcagaataacagaacagaacatgtgttttctggaacggtatctctaaagcaaacaaggggaaaaaacaaacaaacaaaaaaaacaaaacacctccaaaatcaaagatctgaggaagaatggtatttatggtgttcccccgaattgaaagctggctgatgatcagaagctctagaatacaggagatgctttcagctaggggttgagggaacatagaggccagttcccaatctcaagctacagaatgcatgtctcctgggttccctgaggctgaatcctgccactgcctgttaagaaaaattggaaaatagttctcacaaagaattcagagcttgtaataagactccttacttaaatttatacctcctggtaggacctcctgtgatgccactgatgacctcgtggccagggagccctaaatggaagctctcccaatatcattggagagatcgccatagatggagacactaatggagttgggagtgagaaggaaagctccatgttgaaatgcaaggtcatctcaacagttacatcctccaagggaatgcttgcctttccctcctccaagtttacttcttccgggtcttcctcattcatccagatagtcaggtcccaaacagagaaaccaggactgactacccctgtcttccctcaaatctcacattcaatccatcacagtccagttgctttactttgctatttactccaaatctatccattgcaccatcttcactgctcacaccatagtctaagccgccattgtgcatggtgtagagagggcatgaccgcaacagtgaatgctgcgtttgatgaactgaaggacaataactaaaggactgtggcttttactgcaaaggaaagagagagaacagagggaggaaaggctagaaaggtagggaggggccaactgtaaattgctttgtagaaccatgttcagagtttagataaagacattactcaagagagaaaaaaattaaggttctcaaaatctacctagagggactggtatataaagcaataaactaatgggcacacttcaataatggtaacagcgctgatggatcaagaagatgcttgtgaactagacatttatgtggtcagaagctgattgatcagatttaggagtgaccaactgacttgtctgccaagttctgtccttgcttgctgtctctctaactaatcagaccttctaagttgacagcacttccaagcattagataataaaaggagtagctatcaccaatgcggtaacagcaaatcccaacaagaagtctatatgatacatttagactacaggcgcctgccaccacatccaggtaatctttgtattattagtagagacagggtttccccacgttggccaggctggtctcgaactcctgacctcaagtaatctgcctgcctcggcctcctaaagtgctgagattacaggcatgagccaccgtgcctggccttgcttcctaaaattatcactgtttcccttcattttctaagccctccaattcttatgtaacaaatttcctatgttaaatcctttctgttggaatcatttgtttttctggctaggccctctctgaaaataatttgtgatggatcttctcatctcttcccctgtgacacgtatcttgtgaacgtcccaacagcatagaagttctgcaaccttacccaacaagccccttgcagtatataaaaacctaaatctttcattaaggggatcaagcatgctgaaacaactgtgacagtgacaatgactgtgatcttctattggatactactccgtagtatgacagttagcatcacaagctgaatcttagatttggaatattttcatggtaaacttttaacatatgatttttgcatatgattatatgcaaagagatacattggatatattgttagtagcactgagggtgtagttaagcatatgaattactgctgggaagagagccaaaattaacagaaaattaacttactaggggtttctatcaagttttacaaggaaggaataaactgaaaaagtgaacataattgggagcaacaggaattccgcaggtgaaggactcaccattatcttgtcgctgtcaataatggtgttcaatctgtgtgcaatggttagcacggtgcagtgggcaaatttctcccggatttttttttgtattaactcatcagttctgcaatcaaagaagttaagtttaatttcgtaaagatgcaaaaagtagacttaagacttaaaaagctctacttcacaatagagatttaaaaaaaaaagatcatatctatttaatgttttaaaaatcatgttaaaatgttttaggacaatcttattctttaaaaacaagtataaaaatctatgtagtaatttactaattttcataaaacaacgaaaaatgtcttccctccaaattgcttaaagctgattattgggagtggattttaggaatctagctctcctgggatactgaataatatctctgacactggaaaacacgtttgggtttcttctttttttttcagaatgaatttatccatgttaaaatgttatgtctggggcaaacagagcacttagaaatatttctcagaatcattccatgtttcccatttacacacttaaaatgtggactcaaggttacatggacctcagctttataccttggatccacatttgccgtcgcttcatcaataatcaatatctgatttttcctgagaattgccctggcaaggcacaccagttgtctttgtccaacactaaaattggatcctgattctgctaattcagtatccattttaccaggaagatcttcaatggtttctttaagttgtacctgtagatgtacaaagaagaatgactgctatcattcaagccgctatggaagtagtcaagcctcatagacattagaaccttcaagtcccttctctcgagagatataacttaagtggacacacacatgaggctgaattacctctagttaatgttcaatgagaaagatggtagagtcaacacaaaacggaaatattctgacttaagagaacaaacaatggaacccaagatgctcctttatcaccatcagcaaacacagtctgttcatgcagggtcacgtgttaatactgcctgggccaatttcattaagaaaaacacagtatgatcaataaaagtattctgtaggtaaaatacagaaagataaaaaaaattcccttctttttagttaaaagattacagaaatttagagagacaataagagtgatggttgccaaggggctggaggattaactgtaaatggacacaaggaaatttcttggggtaagagagatgttttaaaactggattcctgcaatgactgcacaactctataaatttaccaaaatcactgaatcacttctaaggggagcattttctgctatgcaaattagacctcaatagagttgttggaaaaaaatcatatcagtgtcccccagcacctgaactcccttaccaataaccaacatgacagccaacaagaacccctcttccaggtagggaaggaagtttctcaaaaaatgaagctcatgctcccaatatagagtctgaagaaaaggtgaaaggatctttctggttgagtcaagtttcccaaagcacattttggagacgagtgagtataactcaagggaaaatttaaaaagaaaattactgcaggaagtatggtcctccaaagatatcatcttataggcactttaccattttggaaggttttttaatcaactggaaaagttaaaaaaatacaaatgcaaacaatgggaaactgtgcctcatttgttaggaaatcaggagcttattcttgggctggtcctttcccaagtttaagcccctatggctataaagtaggtcagtacattttctacagtctaataaatgttttgcagtgaatgaaaactcacaaaaaaacaggacacaatataacatcttgccccagacgacggggatagatgatgttgatattaatgtatctttataaaattgtagctataagatgatctgatactacattgggtggtggttcagttcactgatgtttgttttggagaaattttatagaacaagagccaaactcaggtgacatttgagagctatagaggaaccaagagtcaatacatctccaattaagagatcagcaagcagatagatgagtgatggccaataagcaggtgtacagaactacaatgcccaacaacaaaaagccaagagtaaacgggtaacattgtcatgtaccttaaacacggaagcacacttctatgaatgtgatcttgagttgtactcatgatggaagtccaactccaagaaacaggaattttgagttaagattaaatatggtattgatatttggcattagcatgcaaggtaggaaattaaaatccgaagtgtaagatttggctcgtggtgcaaaatgttaccctgaaaattataggatggaatatgtcagcttagtcaaaccctctccattacaaagaagaggacttgctgagtaatctttttatgaaacatactcacagacctataccccatgtgatggaactgatcaaaagtagatgttagcaaagtttttattagcttttccttctgagttgattttgataatactggtaagtgcaaaaaggtcttttctaagaccggcagccagatttgaagaaataatctcacacttgcccttgattaaggggccaacccatcattcttctgggttttgaccctccttgaggttatccacattgacttgatgaagaatagggttgtgaggtgaagaataatgaacacatttcccagataacagtgtcttctgagactctgtcatcatgattgaatcggggatggttatgagaatgatatgaatgtatggccaagtacagtggctcatgcctgtaatcccagcactttgggaggctggggcaggcagatcatctgaggtcaggagttcgagaccagcctggccaacatggtgaaatcccatctctactaataatacaaaaaaaattagctgggcatggtggcgggcacttgtaatcccattaggaggctgaggcaggagaattgcttgaaccagggaggcggaggttgcaataagccaagatcgcgccactgcactctagcctgagtgacagagtaagactctgtctcaattaaaaaaaaaagatatgaatgtgaaggccctctgtagtgttatcatacattcaagttatggttaagtattagcactgagaaaaagacaatggaggcagtggaacacagtgactaagagtgacaactggggaaattgaaaatatattaaacaatggtattacattactcttcaatttcttcagtgaggtaaataactgtattatgtcatgtagttgaatgttcttgttcttaggaggtacacatacatatttaaggatgaactgcaacttcatggaaatgtctgcaacttactttcaagggctataagagaggaagcaaatgtagcaaaataccgtattaacaaatggtgaatcttggagaagggtatgtgtatgttcataatactattcatttgactgttctgtgatttggacattttaaaataaaaaaatggagccttgaagacacacagcatgggtatgagtcctgcctggctctgccaactgggcaagttcctgaactttctctatcttagcttcctaattaacttgtaaataagaccatactaagattattttgaagatgtttatctcctaaaattgttggagtataaaatcagtcagtatgtgtagcatttacaatagtgcttggtaccaagtaagagatcaatagataatatctattctttttgtttattttgctccttcctggacaatgaaatactgcctattctttttttttttttttttttttgaggtggattcttgctctgtcacccaggttggagtgcagtggtgcgatctcagctcactgcaatctctgcctcccaggttcaagcgattctcctgcctcagcctcccgagtagctgggactacaggtgcataccaccacacctggctaattttgtttttgtatttttagtatagatggggtttcaccatattggccaggatggtctcgatctcctgacctcgtgatccacccgcctcggcctcccaaagtgctgggattacaggcgtgagccactacgcccagccgcctatttttaataatgcagtcagctagttcttttcatgcactgctgtagttttcttcactgcatttaccagtacctaatattatattacatatgcattttcttattttctatcttccatacaagaatttgtgccctaagagggtagggattttatctctcttgatgactgctatagctccagagtctacaatgcctatgtaaaaacctccccacacataatctgttgaatgtatgaagtcacaaggatacctcattttgtgacatgtctattcttataaattacaaagtaaatccacaaagaaatagaatttacatacaattttcttactaaatgtcattgtaaaagaaacagtccttataaaattaattggctccaagatatcataacattatactttaaaatatagaaaacttaatgttttctacatttaataaaggttgtaatttcaggaaaacaaaatcaaatcatactatttgaaactatacatttcaaacacaatgtatcaggttattttgaagcttagaaaaaataggaaactacaggaaaagtgaaaataatgaactgaactttctaagacagcccatttctatcatcataaatgttttcaaagcctcaaagagactcatgtggatgtcagattctgtttccatgtttctttgaactttctgacttttcataaaggaagtctctgatgccagagactgaaatgtgataaacagcaactcaacagatgggaacaacctttaacaagaacacagctaagtgtgaacgaagcgagcggaagcccattctgggcaatacaggcctgggaaaaatggaggtgcaaggtgtggggaatagaaggcccagaggatgtggacactgctgatgtgcagatttctgtcttatggtgtcctgaatacaagacatccttgtattctaacagcaattctatcaatgttgaacatgattagataatttctccactattccaacatgatataacctagtcttaattgtagatcccagtattaaagtcgttttttaattaacagaaataacgtgctgctgattcattttcttagttgtacctactgtgtgatcttttgacttttttctcataaacgacttccatctttaatcattacttacgttatatttacagagttgctcttatttaggggcccgaagtggcactaattctagtaaactttcttccatttacagctgactatttttcagtatttacgataactttcagcattagaaaagaaaccccaaaaaacgagcagggtgtggtggctcacgcctgtaatcccagcactctgggaggccgagacaggcagatcacttgaggtcaggagtttgagaccagtgtggccaacatggcaaaaccctgtctctactaaaaatacaaaaattagccaggcatggtggggcttgcctttaatcctagctacctgggaggctgaggcaggagaatcacttgaacccaggaggtagagtttgcagtgagctgagattgcaccactgcactccagcctgggcgacagagcaagactctgtctaaaaaaataaataaataaataaaaataggccaggcgcggtggctcacgcctgtaatcccagcactttgggaggctgaagcaggtggatcacgaggtcaggggtttgagaccagcctggccaacatggtgaaaccccgtctctactaaaaatacaaaaagagtagccggcatggtggcaggcacctgtaatcacagctactcgggaggctgaggcaggagaatcgcttggacccgggaggcggaggttgcagtgagccgagactgtgccaccgcattccaacctggatgacagagtgagactctgtctcaaataaataaataaataaataaaaataaataaataaaaaaataaccaagatgacacaaccacatccataggactgtctccctccagatgcccgaacttcttttgcatgtcaggtattaccctttccaagggatcatgggtaagaagaaataaaaaaaacttccaagaaataaaaggcatctttcctttttatgtggttaaaccaccttttaagtggttaaagaggaaaaaactgacagtgctgtcctaatctcaagccaaccctctgagtttgggttcccatttccagtttggcctcatttataaaccaagtgactatgttttttgtctgctttaaagggggtttccaaatgacaccaggtttcctactaaagagcaagatgagttatccagttctgaactggatatcaatgaaagatgaaaaccatggagacagcagagagacagaatgtgacagagaagtccagagaaacttgaatggcaccagagtcgtggtgctgaatcccttgtgtggtatctctcaagataaacacacacacataacttcacgtttacaatcaccaggaagtaagatttggaattctctacgagaagaccctcagactccacggaccccaggggaagaattcctgacctatcagaatgcccccagcctccatcaacttgtagtcatgaaacttgttgtgaaaaactcacaatgcttcatttgttaggagtgctcagcctttcccctgaccatctagaaggtaaaaagaatacaagcacccagaaggaaatttggaaaatccaggaaaactgtagagaaaagaaaacactctcctccagtctttgtctcattacccccaaacgagcaatgtaaatgctctggtgtctttcttaggtcaggtgtcagaatataagaatgattaaaaacagctggaatcacactggaaatacaatgttgtaccctaatttttagtaactcttccaaatcattcacagaaaaacctacaatgccataaagaagtagttcccagagaaagacaatgatgggataatttttcacttctgagggggacctaccacgtcttccacctcatcatttctagaattcttgagaggctactaaattttattttaattttggctataacaaatgaaataagtatgagttacagtcaagttccatgatggtttttgataggatcatctcccaattaacatttcttcactgttcatagagaaatgtgtttctaaaaagtacttttgctctctgagaatctgtgacaaggaatctcaagctctgaaacaaatagaaaaacactttatgagtaattcttgttcttttagggtgtgtcacaatttcactattaaacctgtcctgagagtttaggggcacaggattgccttatctttctttacatttgacagttaactgtacccacctcttctctcctagaatttcactgtacagagattcacaaatttaaatgaaatcagaggtcaattgcttatcaagtatcaggaggtgaagtaatcgacctaatttagaaaaagaaaatccccacagttgctggaaagcagggtgggtgtgtaaggactcggcaatgacatgccttcagaaacaagaattactggcaggaaactgtcaggcctccaagtctacttgctcacagtcaaaacccatctataaattaaagatttcagagctatccctggaagggcaacaatgacaaatgcaccaattcaaaacaacaacaataacaatggagggaaattaatctctgtcactcaggctggagtgcagtggtgcaatcatggctcactgcagcctcgacctccagggctcacaagatcctcccacctcaactccctgagtagctgggactacaggtgcatgccaccacatctggctaattctttttttttttttatttttagtagagacaaagtccaccatgttgtccaggctccacacttctttgaaatgaagagatcaaacatattaatacatacttattaaatgcttacttttttttaacttttaatatttattatttattttgggatggagtttcactcttgttgcctaggctggagtgcagtggcacaatgttggctcaccacaacctccgcctcccaggttcaagcaattctcctgcctcagcctcctgagtagctggggctacagatgcgcaccaccacgtctggctaattttggtatttttagtagacacagggtttcaccaagttggccaggctggtctggaactcctgacctcgtgatccatccgcctcagcctcccaaagtgctgggattacaggcatgagccaccgggcctggccaatttttatttttatttatttatttatttattttgagacggagtcttgctctgtcgcccagatgggagtgcagtggcacgatctcggctcactgcaaccttggcctcccaggttcaagcaattctcttgtctcagcctcctgagtagctgggactacaggcgcacaccaccatacccagctaatctctgtatttttagtagaaatggggtttcaccatgttggtcaggctggtctcaaacttctgacctccagtgattcacccacctcagacttccaaagtgctgggattacaggcatcaaccgctgcacccagccttaaatgcttactttttaaaagcaaaagactaaactaggtcctgtgagggattaccagttttatgatatggtttctgccatcaagtagactggcacaaatttgcagaactagactgaacacagaaaatcagtgttaaaatacacaaaccaacagcaccttaatagtcaaagtccttttttcatgcaagggtgagaaaatttcaagaagtggcccaacaggaaccacataaataatagaaaaatcctctagaaatcaacatattagtataaaaccttagcagaggctgcagggttctgttatctgcattaaaattacacgtttgccaataaataattattatcccattccaactgtataatttacctttataaacactttcttataaaacttaaagcatttcataaatatgatctatcttttagttaatgaaaaacgactatggtcttcccttactagaaattccctaagaacagagcagtaaaataaatggtgcagagtaacttagtcactaataggatctcaactcataaatacaacttctagtttaacgcattgctaaagacaaataaaacaacaccaaactgttttggacaacaggaagaaaattaaaatgagaaccagggaaattttatttttggttttcatcatcatcagtatacacattatagcatatccacatcctcaatgatctcctgggtggtgaacaaagttagttaaaccgctaagctcctcttaatttcctgcaatgctgtaaaggtacatatacacatactgaggctaacagactaaagataattacattttatcaattacctcttgtaaggcattccacagttcctcatccgtgtgctcattaaagggatccaggtttttcctcattgttccagtgaacaaaacaggttcctaagtgcccaaaatagtcacggtcattaccacagactcttttttcattttattccaatgctaacatcaacaatagaattaagataccaaaaaataaaattcatgataataattatagcgttacaaatgcctgtttacaaaacaacatatctattaatgttccactgtacaaagcgtgctccaaaataccttccagaccactgaacactaacaaaactgttgcaatgtgctatcttaagaagaaaatgaaaaatacaggcctgatgtttaaaactgttttcctcatattattagcttaacatgaaatataaggatataattattcgagggtctacatgaatagagctatagaaattaactatcaatcatgtaatactggaaaataccgacagcatgattaaagtttgtgcttcaaagccaaattattaagcattttccaatttgcactaaagaataaattaggattattttctccgttggcaaaacagttttccaagattaagaatctctcaccgggcgcagtggctcacgcatgtaatcttagtattttgggaggtcgaggcgggtggatcacctgaggtcaggagttctagaccagcccgaccaacatagtgaaaccctgtctctactaaaaatacaaaaattagctgggcatggtggcacatgcctgtaatcccagctacttaggaggctgaggcaagagaatcgcttgaatccaggaggtggaggttgcagtgagccgagatcgtgccattgcactccagcctgggcaacaagagcaaaactccttctcaaaaaaaaaaaaaaaaatctctccaatgtcagaatgggacatccttttttttttttttttttttttttttttttttttttttttttggccaaaggagatctaaacaactggggccagaggcacctctacttatgaaaggattgcctctgattttgcatcagtgaatccccacattatctcatctgtgcatcaaggttacctgggtcacagaacctcattattaactaagaaagcagggttacctgaaaaccactgtgaaggaggtcataataaaattacatcaatttaaatagctgttcctattcatctgcttcaggaggatcccacaattaaatcactcttggaatatcagcctcttcctggatttcaagagagactcttgaacataagcttaggtaggctgtgtgaaagttttcttctggtagctgggtgcggtggcgggcacctgtagtcccagctacttgggaggctgaggcaggagaatcactttgacctgggaggcagaggttgcagtgagccaagattccgtcactgcactccagcctgggccacagagcaagtctccatcttaaaaaaaaaaacaacaaaaaaacaaaaacacaaacttttcttctggaaggctctaataagccaggccataaggatataggagccccatcaactgctttcaaggataggggcagaacaaggggatgcacagatgtgggaacaagagaaggtgagactcttccacaggtactggagaaatgctcaagggaaccactggcctcaaatctcacctggctttggggcaggactgttcctcctcacttcccaaaagcctgagaagagagataaaggtggtagacttcttttttctccagccataaagaaaaatgatatccagggaggctctcatccctttccctatcgtctccgttttaaggctggtgaggaagaaatggatgtagaaggcagacagggtgccaccaaaaacataagtcctcagcaaaatgcaaaaatggaaacgacggtaaaatgggcactttgtgtgtataaagctgataaagtggccaatatccttccaaaagcactgaaaagtcactggtcacatgatgtttctgaattaccaaatggaactgaaaaattccaagagtcacaggtaaggtctgtcttaaaagtacccaactgaagaccaaaacctgaacaaccatctaaacaatggtgggaatttcttgtgaggggaataaccatcattctggttatttcagattaaaagataaaaacttgacttactctttgtaattatcaactctaaaattccaacctctgcaggcagaacatttcagagtagagatttatggtaaacatacaatcttcatgtaaaatgtaaaagatttagtagcctaagtacatatttattgatggtatatattttaaaatgtcatttagtacgagttttaacctccattgttagcaaaaccaatgttctgttcaacgtattattttaaatgaagcaccagatcaaacctgtttttcattagggtttaaaggtcatactttttaaaaatctttgcgccatactgagtagtaattttgtcctcattactcacataagacaagctgatattaaacatgtgaccaggctgggtgtggtggctcatgcctgtaatcccagcactttgggaggccgaggcaggtggttcactggtggtcagaagttcaagaccagcctggccaacatggtgaaatcccatctctactaaaaatacaaaaagtagccaggcagggtggggtgcgcctgtaattccagctactcgggaggctgagacaggagaatcacttgaacccaggaggtggaggttgaagtgagccaagatagcaccactgcactgcagcctgggagacagagcaagactgtctcaaaacaacagcaacaacagcaaaaaaaaaacccaccacgtgacctaaaaatggccgctctgaatcaaagcatttagtgcagtaaattgataatccctcagcaggactgcaagactgaaaattacagtcttcctagagctttcatataaacttctggaagacaagcctctcattatctcaagaagaaactctatccaccaaccttcagacacttaaaacgacctgggaccaagacaaaaatcgcatggggagttacaaaccagcaggacaaagcacaatactttaccctaatcttgtcccaaaccaggaaacttcgctctcttaaaatatacactgcacagtagctagccacaactgctgctgcctgatgtcctcagagctatgtgtgcatttcaaatcctgaagaccttgattcagggcagctcatctccctgtgtcaagaatcagggaatcacctgaagtcactttaaatcttggtttcccttcttttttaaaaaaaccctgtagcctctgaatgaactgatcatcatccattttcagaagaaaagaacattgttcaccaacaaaggaaaaagaatttaagtcgtgtaaagtcttctttagatacaaaaaggtcaccagctccagggagcagttccatggccttaatgaagacttcagtgtgcagaaacaaaggactgactgcattaggccagaatccaattgtatttctttactagtaactgcatacctacctcttttccctttgaattttgttctcaaaaagaagaaaaaaaaaaaaaaaggaaagaaaatcaggtaataaaaaaagaagtcttaaagagacacactctggttaaccttttcaacttactgaagaaaattcagggagtagaaataccaagatagcagaagtctgagcagtgggctgcttaaaaactacttagcttttgctttgatagaaaaacaaaaaagtccatcaaatatgaaaaatgaatctgtttaatcctaacaaagattatagctgttgatgtatgccaaccgttagggtgctatcataaatgttgaatttgcatgaagttactctttagttgaaaacatttatttgtgccagtaggattggaggagtaaataatccatcctaaaaaaagttttgaaatccatttttccagatccttcagttaagcaaactcttgtctgagttatagtatcaccttggtgttctccttgggaagtgcacttaactaccctgtgtcatgaacacaaaagaagcatacatttcagctaactattctgtttagggaaattatttaggaagtactttcactgttcgcttcttcctgaaattttgaatacaaattgaggggtactttcttaagaattcagtattttttttttttgagacagagtctccctctgtcgccaggctggagtgcagtggcacaatctcagctcatggcaacctctgcctctggggttcaagcaattctcctgcttcggcctcccgagcagctgggactacagatgcgcaccaccacgtccggctaatttttgtatttttagtagagacggggttttaccatgttggccataatggtcttgatctcttgacctcgtgatccaccctccttggcctcccaaagtgctgggattacaggcgtgagccaccgtgcccggcccagtatttgtttcttaaagtgactccaggactggcccctgactatgtatgtcatcatttctgtgccccagttctttcccaggtccttgctgcttaatcctaaccacgaatttgagttgctaatggtgtggtcaagagtgacagaggaccctgaaccataaatgaaagggataagccaggaagagagagaacacagaaactcgtgctccacacaaccccaggaagccatgcaggctagacttgcccaaacatggccattcgaagaaacagcacttggttctgcttttgctgtgtttgctcccaaacttcctagattccctacatcagtgtgtggtgacacaagccatttggctttccactcacttctgaggaagaggggtgtatgctttctgcactgcagaccagtaaccttcatgcaacctcaagtctccagccttctccaccctctgcagccagcgaggcctcggaagaaaaagggctctgagctcccacaaggtaaggcttggaggatcttctgacgctcactagcccacgacacataagtgaatacactctgtttccaaaatgattttcttttagtgcttagtgtcacttaaggttttggaaaaaataaaaataaaaataaaaataaatcacaaatgattcagtctttcaaaatgacctaactgtccaaatgacagataaagttcaaagaaaagataccttttgactttgctgtatatttgctctctttggttatggcttctgggaaccttttgtaagttgggtagacagaaaaacaaacagtactttgggaggctgaggcaggcggatcacaaggtcaggagatcgagaccatcctggccaacatggtgaaactctgtctctactaaaaatacaaagattagctgggtgtggtggcacgcacctgtaatcccagctactcgggaggcagaggcaggagaatcgcttgaacccaggaggcagatattgcagtgagctgagatggcgtcactgcagtccagcctggcaacagagcaagactccatctcaaaaaaaaaaaaaaaaaaaaaaaaagaaaagaaaaagaaaaagaaaagaaaaacaatgagtaaaatgtctgatgagatatcatgctgtccaacaaatacttactgaaaaaaaattgagctggatagttctgagttctgattctactacttattagctgttcatctccaggtaagttattaatctccctgagccttagtttccttcctggagaatggggctaacttgacacaccctgcagggctgcagtgacaatcactgtgtcataaggctccttgcacggtgctgccaggcagcaggagcccggccaagcagggcagcacagtgaggcacgctgttcttcaaatggcaggtgcaaccaatggatcatgaaatcacttttgtgactcatgaccatccttatgtcttttatatgaaccagaatagaatggatataatagaaaatatcagggcgcagaagcatggagtaatatcgtgttgtgagacttttgtttctgtgcgtgtgtgcgcacctgcacaagcccacactaaatcatgttgcaaagcagagttctgatcggggactgcgccagccaacatgggtttaaagtccctaggagagggttcaggaactcaggatctggcattgagattcgccgtaaattccatttgaatcctgactctgctgtttacttgttaagtgggttaagctctctgtgcctcagtttgaaaatgtgtcaaatgaggatgacacagaattgctgtgaggacgaagtgggagatggcaaggaaagaagataaccatgttaaggattctgcaaatgttaggaattctcactacttgtgtaacttgtctgggacgcaacaatcactaaagcactggatctaagagggacaagcccctgttctcacgcagggctgagaaccagtgtcggctgcctgctcgcgaaatgcaaagcattagaggggtactgagagtggtgaggaatgccgctaagaccggggtgggggaaagccagaaaacaaagtgatagcctcaccttttgttccttgtgagaaaaacattagatttctctcttaggcttttattgtgcacatttttttttgtttgttgctgcttcactatttaaatttacataaacaatttggttaaaggaattcaccaaggatcacaaaaatagaaacagaagttaatgagccaagtccttctagaatagcgagtagcaataatgccctaaaggcctgcaccccaatccttaattagaaatagttactattgagcattcctcagaacccagagtagggccacaaacatgttctcatctagtaaaatcttcacaacaaatctgtaagttagtaattactaggtttggtttaaggatgaggaaactgaagcttggaggctaagtgacttcattgaggtcacacttctatcaggcagtgctggaataaaaatgtgggtcgtgttgacgcttagaagatgctctgaaagattctatcccaggcagtctgctgaatgatttcctgggtcgcattaagtattgcacagtccctctagactatgtttctttttttcaaccaacattgagccttggagacaaagccatacaaagttaaaaaggaaagtctctctgtttacaatgcttggagatcaggatctacatggatacaaagcttagcagtgttttgtaagcatgctccctggactacatacatagagcatttgctcaaaagtagggtggaaacttatggaactgaaccaaaacctggtgatgtcaaggtatatttagtctttgctcagatgtgcttccaaaacattactggcagagccaagaatcatctaatgttacttctttatttagagttcttttatgtacacaagcacacaactatttcttattaagaattcattcaaagtaatgcagggcacgttcctagaacctttcatccaaggatataaaagcactttacagacatgcccattatctctgctaagtaaacctcatttggcccatttttgagatgggcataaccaaaatataaaacttgagaatttatactctcattttctactgtaagcactaagtcatgcttctaatagccagagggaatctaacgtgctaaacatttcttcccattttatcctgaaagggatacttttttttctttaaactaaaaataaaaattgtggtacaatacacatagcataaaatttactgcttttgccatttcaaagtcaacatttcagtggtcttaaggacattcacactgttttgcagccatcaccaccatccattcacaagacgcttttcatctgacaaaactgaagtcctatgtgaaataatgtaactcccaaccccccaccttccctcagcccctggtgacgacgcttctcctttgtgtctctgtgaatttgactagtctaggtatctcatattaggggaaccatctagtgtctgtccttttgtgactggcttatttcacttagcataatgtctttagggtatatctgcattatagactgtcaggatttccttccattttaaagctgaataatttcccattgtatggatagaccacgttttattcatctgctcatctggcgatggacacgagctatttccaccttttgggtactgtgatgatcatggatgtacaaaactctgagatcctgcttttaattctttctggaagtggaactgctggatcacattagctctcattttttgaggaatctctacagtgttttccaaagtggctgcaccattttacattcccaccaacagtgcacagggttccaatttcttcacatcctccaaattacttaagcgtgattccaattgttttagaggtcagtgctaggatagccataactgtacttggtctaagataaaaatcacattctccttcccttccggtggcacgttctctatgcttcctactaaacaggcattgaagagttgtttatatccacatgcccagaaagctcattactgcctgggttttgctcttgtctcctctctgtgtttctcttctccagaatatgtgtttgtgtgtgtgtgtgtgtgtgtgtgtgtgtgtgtgtgtgtgtgttcctcagctcccctcaatgactatagagtgttaaaaaaaaaaaaaacccacattaaaagaaaacaaacaaaaaacccagccatgtctggagttgaatatgtggaggtgttaaagtgaaggacaggatggaactgtgaggtccgatggaagccatgaggccccacagctgcagaccccatgccggtggggacaaggtctatgttgctcatgactatacacctggagaatagtaattactcaatgaatactttctgaatttatgttaaatatgaaccaaagcaatgacaggagctcttattgtacaaataatccaatctctagaacactccttgagagtcacttctgcaaaggagaagaaaagaaaatagaatcagagtccgggaaaggatggccaatttaaccctccaccatcagagcaaacactcactgggtctgtgtgaaatacaccacacactctcacaatggtgatcgtaaggaagatgaagcagaagtgcagagagatggaattccgtctctcatgttcttccttgctattctttaacaacctcctggttaaaatcattcaccaagagctagattctaaaagtcaccacaaagccaactataagttttttaactctcacagcccacagtttcacagaaagcccttcatggaggtaatcacctttgagaaggtagctttagttcctacagcaaaattccaacattaagacacttaaaatccacatctccccatagaaacctccccagtgctaaacaaacaatgcatcattttgttctttatggttatcagtggataaaactgtggcatcttagtacagaaatctatctgcgtaagttattaaatatcacacacacacacacacacacagagagagagagaaatgaacaaagctggatatctgatgaaaatacctgttgaaaatatctgctcataaaaacatgctctattgggtgaaaaaaaaaacaatcctttcatccaattaaaaaaagcaataagagtaaaagcaattaaacatagtagctcttataaaaggggcaggtaaggacgctatgacttgcatacctgaggtatgattgacatcttcttccttaaatcgtgaagtccaatttcagttgtcaagatcttatcaatccaaattttaccttcgggttctgacaatctaaaaagggctgagatgagggaactttttccagctccggttcttcccacaatgccaacctacagagagatccaggcggcaggattaaaaaaaaaaagaaaaaaatcacaggatgcagcaaaactaggagaaaactttcggtttttgaagaagaattaaggacattctatattgagtgtagtctaagagtttcccaacctcagcactgatgaccttctgagctggatacttcttcattttggaagctgccccaggcattgtgggaggttcgctagcatccctggaccctactgcatagataccaggagcacactcccaaaatgataccaccaaaaatgtcactgacaaacgtcctctggggcaaaactgcccctggttgagatccactgttctaaaaaagagttgaaaataacagaatctgtttactggcattgaaaagtcaacagtctcctaagtggcccatgaaaaggcaacttttaaattagctttgcttgcaggatctgagtaatctgaatttctgagataatttcacagggatattaattcaagacagaggtgtcagaagtgacataaacgagtattcatttttctagagttctattatttaagataacatattctttggtagagaaacttccaaatattaaatatctgcctatattttgtctcaaaatgtttcaaaattctgaagtgaagattgcaatgtcttaaaagacagtagtaaccagtagccaaaaaacacataatgagatcaacaacaacgcaagtaacatttgctatttacgtaaggcctttcatctgcacagttcaaaaggcatgctgcaaactaattaatacttacaattgccccttgagaaacatttgtgtcaagtatcactcctctattaaagccaagacagagagaaatgaagtgcactgccaatacgatcaaagaatcaataaaatgctggtaaaaaggtgggggcaatacgtctatattgtaaaaactggctttcacatgtgtgcatataaatctgtatgcagaaactggcctctgcaccaatgaccttgcacaactgcaaatttcctggtgggaacttcccaagaaatgacatcctccttatttagaaatctggagtcaacgaaggacataaaacatgccttcaatcatttgtccattatttaataaattttaaaactcactgcaaaactttactgggcactgggtatgtgttggaaatgtgacatattacctcatttgaacacctccatatctgtaaagtcaataatggcatttccacaaggaattttatctttaaagagatacatgtacaaaatataaaaatgtaaatgtttaaaaagtggctttagctaattttattaactttggagtcatattctaccttatggtaaatcctagtttatactttataggtgggccattttctgcacataggtacatccgggtgtgtgtgtgtgtgtatatatatatatatatatatatatatatatatatatacacacacacacaccaattgaatttctgagataatttcacagggatattaattcaagacagaggtgtcacaagtgacataaacaggtattcatttttccagacttctatcatttaagatgacacattctttggtagagaaacttccaaatattaaatacctgactatattttgtctctctcacacacatacacacacacacacgtgtatgtgtgtatgtgtgtgtgtgtgtgtgtggggcttatgtgtgtttctcagtaaatcagcacgtatctagacatagacaaatgctgtgtttttgagaatgtgtggacactcatgttatcagctctatgggaaactgatccatctgtgcaaacctggacatttgtaggccattattagtagatggccaggatggaccccctcaaaggtagggaacactgagggctgcctacaaccataagactaggcactccaaactcaggtgaggatataatcagcaaaaggcaaccaaagaaaacctggctctggttagttctcttcaaagtcatcaaaattacagtctccaagtctttcataagtcaccaatgggtttcaccaaatcctctggagaatatcactaatatcagtaagtttacattcataacacgaaagagacacttagttttattttaattgctttacaattgaccctttttgtttccccaactgggccaagagtggtctctttggccaaacattagacatttgtacttggatctctcttcatatatgaaactcaacatgattaatacccaacagcccccctccaaacagctgctgcttctaactcctccattttaatctaataaattcttccccaagttcacaggctcaaaacacccatctcccaggttttctcaactccaagcactaaaaatattacttgttctgtttcttgactcaataccctcactttaatttctgcagccattacctcagtgcaaggctgcattaacatttgaaaaacaaaaactcttttgctagttataatcagtgcaagtgaattcgaaaaataaataaatgctggccacaaccccagcaatctgacagaatccttgtcacatgttaataccttttctttctgaacttgagtgtgagttatctgtgttcctaaagatataatctcatatatttaggcaaaatgagaatatgcacagaatattataatctattatttaataaaagtatttacttcagtagctacataatattacagtatatatgattatttattcaacaaatcccctatttgtggatgtttaggctccaatattttgctattgtaaataataccatgttaaatatccttgaagctacatctttgcaagcaatcttaattggtttcttaaaataaattcttagatgtggaattgctgaggaacaggtatgaacattttcaaaggaggctgttaagtgatgccaaactaccctccagaaatatgataccaatttctactcccacctgtatccctgcaaattcactaaccagggtattataactttgttttaatcaacattagtttgattctacaaagtggaatcacttgccccatcacatcttgccagcagtacataaaatcaattggcttcaggccttcagcgtcttccccgtgcactcatttctcagattaaacttccgaagtacagctctctgcctggcactccacactgggaaacctcctctacaaaacagtcccaactaacctttccatccttagctccatgagcaggattgagtttgcggggtggctgtgaggactaagtgtgcacatgtgtgttattcacctggtagttcatgcccttgtatgctcagagatgcctaattcttcatatcaaatcacggcatcgagccttggcatatgccatcgtgcctttcacatgcatttcgacctgctgaaatcctaaccaccttctaaagtctgtttcaaatgtgtaattgccttaaaatcctccacttgtcccctcgtgtggatttctcccacacttaatggctgtcgtaacatcttttctaaacagccataaaatctgcgaattccttctatcttacggagcaggcatttatatactactttgtttcttctactaggcgacaggtgctgtgggcagggcctatattggaattagctttgtattatttgtatcacctgtggtgtcctgcaaaaaaaaccagaaatcccccagagagttaagcatttaactcaggcttgaaacatttatgggaaatctattgccatattgttcaggtatacaataagctaggtgttttacacctcttatcttgtttaagttataaaactctaatggctaggccctatcacttgcattttgcaaaagagaaaaatcgaggcttagtaagattgattaaactgttgaaatgactgagcccctaagtgatggaatgggacggaaacccaagtctgcctgcctcttgcccattctgccgatggcctcccaatcacttggatagcctggctctgtattcccttggtgtagctagaagggagacagcggggagaagtgtggttgtctttaaaggcactggcctgccatactggtcctattgtcatacatttaatgcatgctgtggacatgcgtgagtataagaaggtggctaggacaagaagctgactactgtgagccaagacagtacctgtattagggtggattacagctgttgacaggaagaactggcacccacagaagaggctgggagagaagcctgcagctacgttggacatggggcaactgggaaacaggccagacagacctagtgtactgtggggcagtgagacccattttgatcccatcagtagtgaacggaactcaaatacatcgctgtgctgagctggtatgaggacagagactgctattcatggaaggctgtatggtgggatgaaaactgtgatagaagacagagatgaccggaaaggtgcaaatgaatgcataaatggggaatcacacagaattaaattgtaatgtaaattcataatttgcagaatataaaagtaaaaaaacaaaaaacctgtagggtggcacttggcccaggactatccagagtctcatgtttagtcacaagaggggctggggcaatccacgagctccacttcaagttgtcaaaggaagtttcttggaaatcacagattattagtcatccaaaattgcttaccggagagcaacggctttaatgcaggggcaggagtgggggtggttcttgtcccagtgcaattttaatcaaaagggtggggtgggcctgacagtctgcatttctaacatgtttccaagcagaggcaggtgatgctgatcccagcccctgagatgagcaagcaggcagggcaagtgggacaatctggctgtgagaggaggggtttctcagcaaacattaatgtaaaaaaggagagaatataagaaactaatatttttgcacactatagcaaggtctagtacacatctgtaaaaaggtattatccaagtaatagctttgagcaaggaaaaaaaaataacaaaccaaaatcaatctacctctagagctgaaaaatgctttaaaatggcccagtactctctaaaatgattaaatcaaccacaaaaccatctaaatgaaaaatgcagccagtgtttggaatctaaccaggaaggctagggtggtatatacctcattttggttcattcttttttacttgctatttcttctgtgaattagaaacctacttagcgcctattactttttcctatttgttataatgtccaggaaatctgagcagatgaagcaattgaaagagaatgaagccctgtttctgctgtgtggacacattcctacatctccactggaaacaatgcccctctccatcagctccaacagcaaagggactgcctgagatcctggggctgcaggcaggtgtggaggagacgaaccctgaatatacacacaaaaagtggaaccaactcaccacgatgttgcctgaatacacaaatgaagctaaaggtgacactgtgagtgaaccaggacacaaatcaaaagccaagtggggctcagcgcagtggctcatgcctgtaatcccagcactttgggaggtcgaggcaggtggattgcttgaggtcggggttcaagaccagcctgaccaacatggtgaaaccccggatccactaaatatacaaaaattagccaggcatggcagcgggtgcctgtaattgcagctactcgggaggctgaggcaggagaatcgcttgaacctgagaggcagaatgagccaagattgcgccactgcactccagcctagatgacacagcgagactctgtctcaaaagccaagtggttgtagctataattcagtcttcaaattcaatttaccctcccacatttcagatctcaggtaatcctatgatttgggggggttttaagatggaacgatatcaatgtggggatataggttgttttctaatgtgtacaacagaggtttgtagataattcatattttatggctacaagagaaatttacaacgtggccaaactaacagaatgatgttgatcaggtaggacctaataacacattgtctgagagtaagcaaacatccccctggccccatcaggaacagaatctgagaaaccttgctttcagcaagagctacagctgatgctgcctgcagagtggtctccaccttcttcacactcacaaggatgctgggtagataatgaggaatcagcttttgctggttccctgggtatcttctgggcatgaagctgtatatttatttttcatggcacaagggtatcattcattcaattgtgactatagcccattaaatgggtctgtggtgggaagagctgaaaagagcagttccgaaagtatctaacactgacacccagagaacgggctgttgcgggagctgtcgtgtgtgttttgttaccgatttctttgtatgtgcatatccctcactctcacaggcacccaccatgtgccctgcagcatgccattttctgggggtacagagacgaatataaaatgctccctgactttaagaggctcagggtactgtgagatgctgacccagaattataaatcatgccatcgtgctatcttctttaaaaaaaaattgtggtaaaatacacaaaaggtactttatgtacttttcaaattgtggtaaagtaacataaaattgatcattgtaatcacttgaaaatgttcagttcaattatattaaatacattcatgttgttgggcaaccgtcaccatcatccatctctaaaactccatttatcttgtaaaactgaaactctgtacccattaaacactaatgcccattcccctacccctgccgcccaccatcctactttctgtctccatgactaactactccaggtacccacatgtaagtggaaccttatagcaccgtccttaggtgtctggcctaattcactcagcataatgtcctcagggctcatccatgtcagaatcacacatgtcagcatgtgtcagaatcaccttctttttaagtctggataatattccattatgcgtgcgtatcacattttgtttttccattcctcagtcaatggacacttgggctgcttccacctactgctcactgcaaataatgctgttatgaacacgggtgggccacagatgttacattaaagaatctggccaggcatggtggctcatgcctgtaatcccaggcatgatttgggaggttaaggtgggcggatcactttagctcaggagttcgagaccagccatggccaacatggcaaaacctggtctctactaaaaattcaaaaatgagttgggtatggtggtgcacacctataatcccagctacgggggaggttgaagcaggaaaatcgcttgaacctgggaggtggaggttgcagtgtgccgggaatgtgacattgcactccagcctgggcgacagagcaagactctgtctcgaaaaaagaatctataagatgatgtggagaatatagtttcaaagaggcagagatgcttgaactgactgaaaagggtgcacactaagagcaaggcagacaggtgcttggggagaaggagggcaccctgagtgcaggggatgtgtgtccatattgggagttgtgaggagaggggtgggaaggggaagagattctactgtcttgtttgttctggtttagttccttcaagaggctgtcctagtcctagccaagggccccaggacacatgtgaaagggacattgctggcagacttagatacctgcaaaaccagctcacaaaactccacacagcctcccaagtccctccttgttttcctttcactgactttgagtgagtctctggtgcctttactgcctccagcttgggggtctgatttctgagcactgatggggtcatgggatctgggtcttcccttgggggctgagagccagacaggtcctgtcagggtgggcctggggctcattaaggttgcagcagctgctcacccaggcaaggagctggccacgtaaggatcagatctgtgatcaaactgtttcagaaagaaagagtttgcagtgaaagggatggggagggaaagcaaagcacaggttaaaggaaggcaagaaagactaaggaaagggcctgataatgtttggctgtgtccccacccaaatctcatcttaaattcccacatgttgtgggagggacccggtgggaggtaattgaatcatgggggcaggtctttcctgtggtgttctcatgatagtgaataagtatcatgagatctgatggttttataaggggaagtttccctgcacaaactctctttgcctgctgccatccatataagatgtgacttgctcctccttgcctgccatcatgagtctgaggcctccccatccatgtggaactttaagtccattaaacctctctttcttctgtaaattgcctagtcttgggtatacctttatcagcagtgtgaaaacagactaatacaggaccaaaggatggaggaggagaaaggctggaacagaagctgcagcagtggaggggaagagaaggacttgagaaatgcaacaaagtaaaaatcgacagaattagacataggagtgttggtgacacaaagccagagttgacttcctggaaaaatccatgagtaattaggtatcaaacagagtatcctgggtcacgttaagctccagccctgaggcccggggcccaccaaccacagtaaagcagttcacagcaggaagaatgttggtatccacattccatggttagtttccaagacaggttaacctacgtatcactgatccccttcacacatccacaaggaagacaacaagcagacatagcactaaatcttctgaaattgagaagaggcaagatgctttaaacaaaccttttcttgtgatttaatgagtgctgtcagatgcttcagtaccagaggcccacctggactgtacatgaagttcacattgtcaaagattatcactccttcatggggccaggctggtggtgggcgtttctgatattcccaaggtgcttctttttcaaggtctgtgtattcaatgaccctttctactgagatcatctgaaagaaatatgacatcccgaggggttaggaatggagggtgtcatttatggatgttaagagactgtcaatgaaatgttcttctttcatacatagttggttaaggagagaagcaggagacagacgaggatgttgatgacttacaaatttggttcatcattgtgtaacaccttcacttacaaccacttccttcaacattaggttaaaagaatgagagaaatgaatgcttagattttatttatccacttctcacacctgtattaaaggcaagaaaattttgtaaaggaaaggaatacttagagccaccaatcaagaatcttttgctggctgggcgcggtggctcatgcctataatcccagcactttgggaggccggggcaggtggatcacctaaggtcaggtgtttgacaccagcctggtcaacatggtgaaaccccatttctactaaaaatacaaaaattagctgggcgtggtgctgcatgcctgtaatcccagctactcaggaggctgaggcaggaaaatcgcttgaacccgggaggcggaggttgcagtgagccaagatcgcactattgcactccagcctggggtacaagagcaaaactctgtcccctcacccctaccccccaaaaaagaatcttttgctatagaaggatcacctgatataggtcagttaaactggatgatcgtgaaacctcactgtaataattactcaacttttgctctatgagaagaatgaaaagatttttatgtttattgcttttctctctttaggggaaggtgcaaatatttaaaacattgattaaagcctcctataccaccataaactaataccctttgactagcacattccaagaggaggctttctgtaccaagaaggcacaccagcaaagttaaggccttcctcccttctgttcttcacataagagagtaaacgctagaactgggagaggaggagacctattaattaaatgtaaacaacctcaaaatactgaagtcttcttttaacaggaatgaggaattacccgttaagaaacaaaattaaacaggcttctaagaaattagcttatatcctctctagaatttcagaacctccctcctacagagacatttattacatctgaaaaagcttgtgatgaatataaaacctgctgacagagcaaccataagactcagaaaaagatgtatatattttattttacattaactttaaacagatggaggaaggatcttaaaaaaaatctgttaccaaagatgtaaaaataacagttttaatatttcacataagaatggcttttataccatttaatggcaaggagattgaaaaggcaaagaacgtgaaggtaaatattaccatattctcaacttcagcactttgtcgaacacaccactgaaacatccccatgagcgtgagggcataggacagtgccaaaccaacctgcccggcatccagagctacgtaaggaggaagaagggaataaagtcagtctcacttcaaacctaagcctggctccttctgccacttaccaagaggaacccttcataatgttgaaacaattcacatttaatgacattaatagctatacttttaccatttgttgcttgagatcaagatacaatggggaaaacaacactgtatatttagaaaaatttttagatgattttatgaattccaacaggatcgacatagatttaattaacagtattacaaacgcaagaaataatgtcattattcagacattcattattatggtttcaaagctcattacattattccactttctacgtgcaatgcaaccacagctggaaaccactaaaaacaaagcaataggttgtaagtgccaatgcttttgagactaaaatactactctccttgttccattattaagtattgtaatgcactgttgttactggggtggtgaactcatgccctgcttgtctggtacccatgtggcattgaagataatactctcctgctgagaatttttctcaacctcatgcaccaggcaactacaaacaatagattcaagtagttggaaggctaacaccctaagttggacaaaatgcttcagaataaattggttttctcttcacaactaccagacactaacaggaatgttcagaatctcaactgcgcatatctcaacccattcaaagaaagataaacccatcaagacccaaatgactccttaaatgagtcacactgctgaatcctacccaacctgacacatcgtaaatgatttaatacacttcattaggaccaaacagtatgtagtagtagacaaggtggcaagagtttaataaatgtaaacacagctataaattgtaatcataccatacatagttattcacatctgtacttactttttgccagaatcagggacccaaaggcaacgatgatgacaaacatggcacagatggcatccagacggacggcaaaccagcgggacgttgtcaaaaacaagaaccaagcctctgaatttgagaacggtaataagcatgatgaataagtagatgaatgtgcgagtgtgttttgctcagttgagctacagaagatttttacgtggagtagggcaccaaagttgcacacccaaggaacctttagattccagaaagctaagtgatacaggcaatatacgatacacatacacaatggtaccgtggctttctgtgaggatgcatgcgaatatgaaacccagaaatatgatcctaataaagaactgagaaaagtagtctcataaggacatctcgtacagtgctgagaaatacttatgtgaagtgcatctcatgtgaagtccacccacacacatggttgactggtccagttctccaacagcagagtgcagctcccattttacttctcccaccttccatacttaccagaaggcccacacacactgactattgcttaggggctatataaaaatgacctcactaacaggatttgcatgtggttttttgtttgtttgtttgctacttcttttttccttttagcatgtggtttttaaagtgccatttaatcagcaagataaaataaagattggaatgacggatctgaattttgtagatttggtggaaattctgaaatttccatattgaaaaaatcttcactgatgcaaggggtcagcaaactacagcacgtgagccagcacctatttttgtaaataaagttttattgaaacatagtcacagccatttgccaatgtattgacatctgcttttgtgctacaatggcaaaggtgattcatcacaacagagacaataatggcacacaatgcctaaaacacttactaggtggccttttgcagaaaacgtttgctgacagagccacaggccatgcatggtgagagaaagaccccacaagccagtcagggggcacaaagagggaacgtgcagcagcgattccgagaggagtccaagcccagaagaaggggatggggaaggagacgaagatgcgcaaaaaaagcaggatgtggggctgggccctgaggtgcctgccaacaagctcatctgaccagggaggttaagccagaaaaagcagcagatcctgtcctttgaaaccatttccagaaatagacagacctgaatgtaaatcctggtgtgcatcaaacagttcctgacacctctcttctgctttgtatgcccggatggtccagagcccctggagagaagatgataagtgggaaaacactggactccgagctggggaaacagacagagaaaacagctcagtgaggctgggtgcagaaaaacctgcggcctcccaagctccatggtcacgtatccaccaaacagcacacgcaggcctcctaggaggcttcatgtttcaaggaaaaataaatgttcccaatagcctgaggggaccctgccactggaatctcaagctcctgctcaaaccacacctcacataaggggcctggaaataaacgtcctatttttgaccacattcaaatctagttataattctttccttcctaactcagccttccaggtcttcctcctctccatattcttccctgacatctctttgggcagaaatgatatttttctgatttttgagccagtaggattttaaaaaacaattctctgttaagagtactcaccatactgaattacaattagccatctatgtgtctgtccccaccttaaattgctaatttctcaagggtcagctatagccattgcaccctggtaactggatggtacctggcacaggacatgtactcagtaagtgagctgaacagacagactgtcacttccctgcatcctggggaatcttctgtgcccactcatgctggaagaatcctttgtgatctccatggacctgggtgctgcaatgcccttgtgccgtgcccaaggaacctgcccagccaagatgtctctgaatggtcttaacattggctccaggaaccggacagatgtttttatgactgccccactgcaaacttgtcctgatctctggaggtctctatggcatgtgccattgcttttttcagaatctgactgtggtctcagtgggttcttcatctctacagaattttaagaagtgaattcttttttgtgtgacttcttttttctttgggagctgtatatcccatgaggttccctgaccagctgctcctccttgagccattgtgtttttgtttgtgtggtgtaggtttttttttttttttttaagagggagttgccgccctgccccgacctgcccccgttcaagcgattctcctgcctcagccccctaagtagctgggattacagatgtccaccaccacggccggctaatttttgaatttttagtagagacatggttttgccatcttggccaggctggtcttgaactcctgacttcaggtgatctgcccacctcggcctcccaaagtgctgggattacaagtgtgagccaccgcacctggcctgttgggttttttagaaacaggatttcactctgtcaccgaggctgggtgcagtggtgtgatcatagctcactgccaccttgaattccaaggctcaagggatcctcccacctcaggctcccaagtagctgggactagacatgcacaccaccgtgcctggataatttttgagtttttcatagagatgagggtcctcctcctgccttggcctcccaaagtgctgggattacaggcaggtgtgagccaccatttccagcaggccactgtgtttcaagcacaccatttgatgactaccaggacatacctccctcctgcatagcagcggacatgagggctagctacttttgggcagggaggaattcctgagagtttcaattgtctaccatgaatgaggccatactggggcaggtgcatattggggacacgtgacctagcacaatgtctttagcattcttttctgagataaatgatttgtgctttgcaattagcaaacactgactttgctacctgtgtagctccagagaagaccctgttagtaaaacatggggtgtccgggagaagttaagataactttttatttatttatttttttctgagacagggtctcactctgtcacccaggcttgagtgcaatggcatgatcttggctcactgcagcctcaacctcccaggctcaagtgatcctcccacctcagcctcctgagtagctggaactacaggtgtgccaccacactcagctaatttttatatatttttgtagacactgggtttcgtcacattgctcaggctggtctcgaactcctgggctccagcaatcaggctgcctcagccacccaaagtgctaggattacaggtgtgagccaccgtgcgtggccaatctatcttacaggcgatggctacatatgttttataaaatgatgagggggtagggtgggggtaaggggcggagggagtggaaaatttaagagaaaaattctaactcattttctgggtcggactcttagtacagcatccccatgccgatctgtgctacagctgactcaatactggtgtgcccactgtacacacagacactgcacatttgggggtgctggggtaccagtgtgccaagacatggaggttccacatatatcagagtccagagtccacagttccgtaagtgaaggaggaggccgccaggtatgagacactggggttctgagaaagtgggaagccctgggttggggaaaggcagatggagctgcaggttactgactgtccacccatccttggggctctttcctgactgatacatctgactgggggcactaacttttaggggccctctcctgtgatagtgctttaagaaaccagaccttccctgagcatagattctccaccagaatgtgatctggcacttcccttatgtctaattcaggcagagagcctcccacgagtccacagggttctctctattctctatctctggcatccacaatgtctctactaaaaatacaaaaattagccaggtgtggtggcgggcgcctgtagtcccaactactcaggaagctgagacgggagaattgcttgaactcgggaggtggaagttgcagtaagccaagattacggccactgcactccagcctgggtgacagagcgagactatgtctcaaaaaaacaaaaacaaaagcaagaaaacaaaaagatgactcttcaacacacagagtaaccttttactcgttatttgtgtcagctctctataacctgtaactttgcactgggaaggtggcaggtgacatgaccgtaagaggactgagctggtgcttctgtgagaaaggctggatgttctgcacaggtcttttctgcacgccccagatgttctagcctgcaccctggaacttggtcaatctggaaacagggtgatattaggaataacacaagagaattccaggccccattaccctacaaagagtttggctcccagtagttcagagaaatcactagaaccatgctcttacctccagagcaagggagtgttgtgactgaacgcgtccatcatatagagaatgccactgagaaggaaggagatgtggcagtcatggggacagagtcctggaatgaaattcttcaacatagctattgtcatttgctttcctcatcaggagatccaagtcgccactgttttatctccaactgggtttcagggcagggtcaacttgagaaattaggtaccatcccagttttggaacacccgggaatatcatgaagatcaagctacacactttaattcacaccaaattaccaaggtatagcaggaatttgtaacctttgaaaagatagtcctttctctttcacaccccacttagggctgagagggctgccagtgagggtgagctgggaggtctgcaaagacaactaactagtaccgagggagagcgtatgtcaagcctcagctctaacgtactagtcagcagtttccagctgacacaacctgccatttgacaagatcaatagctgtgttttccacaacacagagaactctttaggatacactctacagagattttctgtcttctctgaaaagaacatgaaaaggaactgcatgcaaagatctggtctaccagtcttgctgcggggtactgacgctgtgtaggacctctcagggttattacggttttaattctcaaggctatagtgcctctggtagttcccgtatgttcaaggtttccaagcagtctcaggcaaccctcataagtattatatccttgacagagggaaaaacagacttgaggcattaagaacactgcccaaagctgggtgcgatggctcacgcctgtaatcccagcactttgggaggctgaggcgggtggatcatctgaggtcaggagttcgagaccagcctgatcaatatggtgaatccctgtctctactaaaaatacaaaaattagccaggtgtggtggcgggtgcctgcagtcctagctattcaggaagctgagacaggagaatttcttgaactcgggaggtggaagttgcagtgacccaagatcacggccactgcactctagcctgggcaacagagtgagactatgtctcaaaaaaacaaaaacaagaaaacaaaaaaaacactgcccaaggttaagtaaagtaagccatgcaagtggtagacttgggcatggactcatatctgttttatttccaaggctgtgcttttaatctgagccacagtatcagagagagagaataatcagagttaaaggttctcatgcatcctgagggcatttttctccagactttgtagcccacgctttaaaaatcccctaatcttacttagctaatatccaacagccttccctattcctgtgccgcttattaaccaccttgcattgaacaaagtccctgggaatctaggatgaacgaacatgggacacatgggttcacactcatggcagacattgctagtggatcacaatatctttacaaacagaaattggatacggcttcacatttcaggcattgccaaatgagtggaggtggctagagaaatgcagccaaatgccattccggtttttatgtacttctctatgactgactgttgatgtggtgactcttgcaaacataaaatgatcaactgcagatttgtttttgttttttgttttgttttgttttgttttgttttttcagtttcactcttgttgcccaggctggagtgcaatggtgcaatctcggctcacctcaacctctgcctcctgggttcaagtgattctcctgcctcagcctgccaagtgcaatggcacaatctcagctcactgcaacctccacctcctgggttcaagagattctcatgtctcagcctcccaagtagctgggattacaggcatgcaccatcacgcccagctaattttgtatttttagcagagatggggtttctccatgttggtcaggctggtctcgaactctcgacctcaagtgatccacccacctcggcctcccaaagtgccaggattacaggtgtgagccaatgcgcccggcccagatttgttattaagattcattaaatgccggctatgactccaggggcagtgaggcagtccaacagaggctttggaaatccttgagggcacaaggatgaagctggattatgcctccctgccacggcagtcaggcatcctgctttcagctggtgactccagcagtggtctcaaaaaccacgatccactgctgctgagaagaaacagtggaattgtgacttatggcagagacccaccaccctggacgaataacagtaaatagttccaaccaaccagcccccgtggttggtgatctgagcgcatggagaaagaatcctgcatatttaactcattgttacagccaatcagggtacaggaacacccaaatatgcctcaggggccatgataaggttgtcagaatctccacatgaaaatgttttcaagctttaaggtacatgctgaaattcaagagagaaaatcctacactgcttcccaaaaagccttcctaagtcccccttttctccacatccacatggatcggatgtggctgttgacacagacagtctacgtcaagatgttccttctggaacggctgcttccttcaacataccacagactcccttaaaacaagactctcgaataacttcatttcatgagcgggcccaaaccataaaatgcctgcacagccttgctgtccacacacaacactggctagggccagtcatctgcacaaggaaggtctcccagcaattatactctaccttccctagcaagtcctattggccaagtgttactcacatgtggactccactgctcggcctgcccactgaaaaccttacaagactagacctcatggtagcttagctggttttcttgatgactgaaaagtttttctacaacttttatggactgtcaccccttctacttcatgcagacacttaggataaatgcctcttagagttcactgttggccaggtgcagcagtacacacctgtagttccagcactttgggaggctgaggcaggtgggtcacttgaggtcaggagttcaagaccagcctggccaacatggtgaaaccccatctctactaataatatgaaaatagtgaggtgtggtggtgcacacttgtaatcccagctacttgggaggctgaggcatgagaatcacttgaacccaggaggtggaggctgcagtaagctgagattgcgccactgcactccagcctgggtgacagcaagactccatctcaaaataaataaataaataaataaatgttcattgttaaaagagaaacatatatatgtcacaaccaaaaactgctttgtcctaataaacttctatttaccactcagtagaagatactgaaaatgatgggactcaatgcttctcttctaggcgtggcttccagagagctgagttggcattcagcttttctgatacaaatatcttccttctttattttttggctattatccttataccttttattaaaaagtaaagcaattctactctccttatgagtttgtgtttaacaatgatgaaatatgttaatttgtgcatgcataatgagatgaactctggattatttcatctctgcgattacatgtggaatagagtgattaatcataaaatgtcttcctcatgattccaaaactaggaaattgaagagagcaacagactatatgttttctaaactgatatatctccttgtgatctaaggggattattttcagtgtccatatatatataaacagcctgagggggaaaaacctcaaactgtgacattagaacaagcaccgctggtaacaaatggaaaactgaaaataacaatgcttatcttttcaaaacgtttaaaactgcaacttcctagccattttgtgagtttgcaaaagtcataaatttaccaaatacattgcttctgacacctcttttcctttctccatccttctcatttccttgtcatttttagtatcttcggggaaagatactaaaataccctaattattttccttctatattagtttcaccatgatcaaatattttatttctaagaaaaatgtttaattaagtgccggctttgtgtaagaaagtatgtcataaacaagacacggagagtccctgtcttcacagtgctgacattcctgtagaatattactccccatatggccttcactccttccttattccaaatgcaaagttgcacgttgcaggctatcaattccacatgctctaagggacacaatgattcataatggccaatacgttcaattacctaatgttagagaaattctggaagacagagtctgccgaatttcagggggtctctgtaatttatggcataaatggaaactagctagcatgtctataccaacccgagtttccatactcacttgtagattccaggcgcttcacatctcttgacgtttccaaaaaatatcgccgaagaaaaatgaaaatgattccaaggggaaccaagggtattgcgatccaaggaatcacggccacagccacagagaccacaccaaccacttgtagcaatgtctgaaatagcagaagtagatgcaggttttccttatcaagtattcttttcaaaaatacttgcatgagttgttgttaggattacactcctttctctgaaagacttattgtagtaccagggactgcttttccatacaaaggaataacaaaagtataggtggtcctgatgatatctattacatgcctgccatgtgccaaacactatgatataaacttatccattaggtttttttttcctttttcttttttttttttttgagatggagtcttgctctgtcacccaggctggagtgaagtggtgccatctcctctcactgcagcctcccactcccgtgttcaagtgattctcctgcctcagtttcctgagtagctgggactacaggtgcatgtcaccatgcctaatttttgtatttttagtagagatggtgtttcaccatattggccaggctggtctcgaactcccgatctcaagtgatctgcccacctctgcctcccaaagtgctggaattatgagcgtgagccaccacaccaggcccccattagttcttttgaaacactcaccagcctcatgagtcaggcattattactttccctatttaatggatgagaaaactgagatttagagtaggacttgaatcccaaactatcatgagtcagttgatgttatgcgggaaatgagcaagcaggcatcatagacaaggaacccagaagcctcagctatgcacgggataaggaagtgactaattgcaaattcagtgctcagaaaaaaaggaaataatttaaatcttcacctttggaagtggggagtcatctctcttggtatctatcctttgctaacatttactgaatgctgattgtatatctggctgtatattaaatacacatgtatcaactcacttaaatctcacaatatccctatgaagtagtattactacaccattttacagatggagacactgaggcacagggagaaaaaagtaacttgatcaagaacacacagcaccagtcacagagctgaggagcatgcattgtcagccactacattttagcttgtccccagcatacggctagctttttattggtcaggataaaatccctgaatttttctctaatttttcccctaaacacacttacataagaaattagagttcattaacatgcccaataaagaatagataagagaaatgtaattaaattttacatgttttaaaagacctgagacttttttctttttattacaatatattgaattttatattgtcagaaatttttgtcttctatttctcttacatttagtagcactgaggaagaggtttgataacaagaaaacaagtcaaaatgtctaacagggttttttttttagctttaacacttggatatgcattaaattttccacgattaggagagtatttcaaacgtctatttcagaggcacatgataacaatagcaaatgacatgtatgagcacgtgcaaggcactgtgctaacgggtctgtgaatgttcacttacccatcacctcacccagcaaggtgacattatctttggaaattaccttggtctaaaaggtgaaatataaaaacaaaagcaagaagcataaaaacccaagacactggatgatgctcatttcagtattcatctttattaggaaacatgtgatatcacggtctatggcttcgggaaatatgagtgcaactcaagttagtccctacctactctgaaaccacaacgcttgcttcttgagaaggatagaacagtgggggacgtgcagattcacgttatacatgctctgaggcctccaaagttcactgtcttacataaaagtacatgacttcagcagaaagtacagagtgctatagaaatataaggagaggccagttgtggtggctcacacctgtaatcccagcactttgggaggcagaggcgggtggatcacctgaggtcaggagttggagaccagcctggccaacgtggtgaaaccctatctctactgagaaaaaaaaaaaatagccgggtgtggtgccgcatatttgtaaccccagctactcgagaggctgagggaggacaactgcctgaacctgggagctggaggttgcagtgatccgagatggtgccactgcactccagcctggacgagaaagtgagactacatctcaaaaaacaaaacaaacaaacaaacaaaaagaaatataaggaggaatacatgcacactttgtagaggtttctaaggaagacttacaactgattttcacaggcaggtttaacagacaaccagaaagtacagcataaataatcacttgcgggtcgcaatcacagtttgcttgctgcgggaacacaggcagttctgtgtgtgtcttctcagcaccaccacctgcatcttgacccaccagcccagcatctggcctactaggccacccacaattttctgtacctagctgacagccaaagaaaggtacaattgccctgccctcccaaaaaccaagaagaggcaacatgtcataagccttgcttatatccaaaccttagtacatatgtatttcgcatccattatctaacttcactctcatatctaaataggagggattatcatctccatttacacaggaggaaactgagtctcagagaggttcagtaacttcctcaaagacagaaaattcagtcatactgaccttacacctgttctcttaatcactgcaagatactatatcctacacacgattcatatttttaaagcatttaataccgaaatatatctgtattttttatatttttgttttctgaattctctagtttttaaggttattgtgtgtgtgtgtgtgtgtgtgtgtgtgtgtggttatatctggtctctcagtgaggtgaccaatcccagctcccagctaattaggaaataacagacttctcagctcaaaaagaagagctgatctttaaaaagtcttaaaatatttgctaatagaacatggcaacacatattgatttaagaattattgtttacatctaaaagtcttacaaaaagatgagttctagacccagaaaacaaaatgacttaagaaaaaaagaagaaccacattttaataaatatataaaacctcaggacacaaaatgaaggttgaatacatttcatattcaatatctatatttgaatggtagtgaaaaatataaaatttcccccggcagactcttctagaattaattttgtatccgaacattacagaatggaacatattcttttaacaagcataattttaactacaatgcctgtttggcatttaaccaccaaactgctttgagtcctggagaaatttttaggtatctatccactatttactttaaacttcattttgtgggattctgttcctgctagtctttgtgaagcttgtgccaacgaacatgttttctataaacagcagtaaaaatgtattcctattttctgcaaataaaaatgccatccatccttctggctcattctattcctcatttgaactctccctctctctgtcaaccttctattaggtacaagatgaaatatgtatttaatcatgaggtcacttaatcagtagatggtattttcatgatttgtttatggtattaaaacataaaatcaggatcattaaggttgctaacacctcacagaaagtggaaagcttttaattctgctgtaagccactgaagaattgtgttctaagctgtgataagtacaaatcatccagattgctttaaacgattactgacttcgcagaagacaaatcttaggtgtaataaacaaagcagggttcacttcttggtgagagactatggcaagattttcttctgatttagagagaaaaaaattgcccactagtttttgatcagtaaggtgtttactgatagggtggcagaagaaattcttctacttatttattttgggaacacatgagactaaaacaaaaaacaaacaaacaacaaacaaacaaaaaactggcagggtgcggtggctcacgcctataatcctaacactttgggaggtcaaggcaggcagattgcctgagctcaacaccagcctgggcaacatggcgaaaccccgtctctactaaaaacacaaaaacttagctgggcgtggtggtgcatgcctgcaatcccagctacttgggaggctgaggcttgcagtgagccgagatcatgccactgcactccagactgggtgacagagcaagactctgtctcaaaaaaaaataaaacctacttctcaatgaaatgactaacataacaggttgtgctcctggctaatacaggatttcttctggagccactaaaattatgaacagggtatacaaaccgacaggaatattaagaaataaaaatgtaattctgtcaaatcattatcattaccttcaattacaggatgaatagaagcaaaagggacaatatggaagacacttaaatgtaagctcctaagcccaaatactgacagcatcagcactaagtcagcagatgtaaattatgtgctactgtagcatctcacctgcctcagggagttcagaggtcaactctggttcccaggtcccacctggggagatctctactttacatctgttttttttgttacctcatccaacccagtgaatgcctttaaatcagaactttatggagtgttggtatgtcttctgtgtatgacaagatctaaacaaacattctctaagcttttctaaacttgtccttcccttgggatacattaatcactcctttcatccctcatatgctaatctgatcttttgacatccagcgctggtacctgtgttggacttcggttagtgcttaatcctgagtcccagctaactccaatgaagagtgaatggtgtaaggcattagagcaatgtggtgcacctctcccttcctttgtggtcagcatatctcactgacagatggtttcctttgtacattttttccatgttaatgtttattatgaaattcaaggctgaagtccgtctatatgctaccttaaaaatacacatcttagaaaaggcatataaaagtggaaataaaagataagttttaacccacttatcttaataactgatataacaagcacataaaaatcgacagagaaaatttgaaaacatgattaataaacttgacttaatgatgacctaaaggctacaatactatagccaataactgcataaacacacttttcaagtgcatctttattatgccataaagcaagtatcatcaaacttcaagagacagatattatacagaatatattctgacataagtggatttaacatgaaatcaatgtaattagaaatgtaactagaaatgttaggaattcagcaatatatttctatataacacctgtttcaaataaattacaataaaattagaaacttttcaaataaaagaaaatgaaaacctaataatattaaaatttcaggactgcaactaatgctgtttacaagtaaaattattccttcaaacttttttttaaagacaggttaaaagtaaaggatctaaaaatataccttacaaagatagaaaaatgagtagcatattaaattaaaatctgagaaaaatggaaattagaaaaaaggagaaaatgattaaatagaaaactaatttgaaggagaaaaatcaacaaacccaaagcctcattatataaaaaaactgatgaaatcaataaacttcaaaaagactaatcaagaaaaaaagagaggaaaattatcattatcatgaattaacagggaataacagaagagatactacaggcattaaaaagaatatataataaacaccgttccaataaattaaaaattttgatgcaaaaggcaaatttctggaaaaatgatgggcaaagactgacataataaaaaacctaaatctgaataattctattattgaatttaagaatatgaattcatgacacaaaaatttcccatagaaaaaacaaagatgggtcacaagatgattttgcagaagttttatcaaattcttctagagaattggaatccagcattatcctgatataaaaaccaaagaaaggaaaattataaaccaaactgtgttaagaacactaagtccgggcccggtgactcacacctgtaatcccagcactttgggaggccaaggagggcggatcacaaggtcaggagtttgagaccagcctggccaacatggtgaaaccccgtctctactaaaaatacaaaatttagctaggcgtggtcacgggcacctgtaatcccagctacttgggaggctgaggcaggagaaacacttgcaaccggaagctgagatcacgccactgcactccagcttgggtgaaaaagcaaacaacaacaaaaaagaacactaaataacatactaaatacactgaatctaagaacataaaaaataattatactttataaactgtttacaccagtaatacaagcctgatttaagatctgacaattaatcaatcaatgctatttatcaggttaacgaaacaggaagaaccacatgatcatataaatagtggcaagaaaacaccagggcttgaacccaggagatgaaagttgcagtgagccgaaatcatgccactgcactccagcctaggtgacagtgagactctgtcaaaaaaagaaaaaaaaaaagaagccaatcccaagaggtgggatcatggcagacgagaggcaggactagattgcagctctgactcggactaacagagcagtgtgcagaggcttgcatgtgaactttagctctggatcgacttcaagaacaaaccagcaatcccaagaggagccacagaccctttgaaggaagtggactgctactgcaggacctaggagacaccccaaatactctgcagcaagacccacccaaggagagtctgagctcagacatgcctagccctgcccccacctgatggtccttccctacgcactgtggtagtggaagacaaagggcatataatccagggagtcctagggtcctgtgcactgctagttcctcttcatgctaccacagctaatgctctctgcaaagtgccaccttccaacaggaggccaaccagtacaaaaatagagcattaaaccaaagctaagaaccgtcacagggtccattgcaccccccgaccacctccaccggaacaggtgctggtatccatggctgagagacccaaagagatctctgtgaggttcacatcacaggactctctgcagacaaccgccagtgccaaccgggaaccaggcagactcactgggtggctagacccagaagagagacaataatcaccgcggttcggctcacaggaagccgtatccacaccaaaagggagagagtactatatcaagggaacaccctgtgggacaaaagaatctgaacaacagccttcagctcaagaccttccctctgacagagcctacccaaatgagaaaaggaactagaaaacccactctgataatgtgacaaaataaggctctttaccagcctcacaaaatcacactagttcaccagcaatggatccaaactgagaagaaatccctgatttacctgaaaaagaatttaggaggttagttattaagctaatcaggggggcaccagagaaaggcaaagcacaatgcaaggaaatccaacaaataatacaagacataaagggagaaatagtcaaagaaacagatagcttaaaaaaaatcaaaaattcgagagacattggacacacttacagaaatgcaaaatgctctggaaagtctcagcaatagaactgaataagtagaagaaagaagaagaaacaagtagtagaagaaagaactcaaagacaaggtcttctaattaacccaatccaacaaatacaaatggaaaaagaataagaaaatatgaacaaaacctccaagaagtctgggattatgttaaacgaccaagcctaagaataatcagtgttcctgaggaagaagagaattctaaaagcttggaaaacatatttgggcaaataatcgaggaaaacttcttcagccttgctagagacctagacatccaaatacaagaagcacaaagaacacctgggaaattcattgaaaaaaatcatcacctaggtgcactgtcatcaggttacccaaaggtaagaccaaagaaagaatcttaagagctgtgagacagaagcaccaggtaacctataaaggaaaacctatcagattaacagcagatttctcagcagaaaccctataagctagaagggattggggccctatcttcagcctcctcaaacaaaacaatgatcagccaagaattttgcatccagtgaaactatgctccacatatgaaagaaagatacagtttttttcaaacaaacaaatgctaagagaattcactactaccaaaccaccactgtaagaaactgctaaaaggagctctaaatcttgaaacaaatcctggaaacgcatcaaaacagaaactctttaaagcataaatcatacaggacctataaaacaaaaatacaagttaaaaagcaaaaacaaacaaaaaaaacacaaagtacacagacaacaaacagcgcgatgaatacaacagtacctcacatctcaacactaatattgaatgtaaattgcctaaatgctccacttaaaagatacagaagtgcagaatggataaaaactcaccaaccaatctgctgccttctggagactcacctaacacataagcactcacagaaacttaaaggggtggaaaaaggatttcatgcaaatcgacatgaaacacagcaggggcagctattcttatatcagacaaaacaaactttaaagcaacagcagttaaaagagacaaagagggacattatctaacagtaaaaggccttgtccaaaaggaaaatatcacagtcctaaacatatatgcacccaacactacagctctcaaatttataaaacaattactaatagaattaagaaataagagagacagcaacacaataacagtgggggacttcaatacttcactgacagcactagacagatcattaagacaaaaagtcaacaaagaaacaatggatttaaactataccttggaacaaatggacttaacatacataaatagaacatttcatccaacaactgcagaatacacattctattcgacagtgcatggaactttttccaagatagaccatatgattcaactccaaaaggaatcttcaaaaccatgcaaatacatggaaattaaataatctgctcctgaatgagcattgggtcaaaaatgaaatcaagatggaaattaaaaaatatttcaaactgaatgacaataatgacacaacctatcaaaacctctgggatacagcaaaggcagtactaagaggaaagttcatagccttaaacacctgcattgaaaaagctgaaagagcacaaactgacattccaaggtcacacctcaaggaactagagaaacaagaacaaaccaaacccaaacccagcagaagaaaggaaataactaagatcagagcagaactaaatgaaatgaaacaacaacaacaaaacacaaaagataaataaaacaaaaagctggttttttgaaaaggtaaataaaattgataggccattagcaagattaaccaagaaaagaagagagaaaaattaactgacaccactgaaatacaaaagatcattcaaggctactatgaacatctttacacacataaactagaaaacctagaagagatggataaattcctggaaaaatacaaccctcctagcttaaatcaggaagaattagataccctgaacagaccaataacaagcagcaagactgaaatggtaatttaaaaattaccaacaaaaaaaagtccaagaccagacagattcacagcagaattttaccagacattcaaagaagaattggtaccaatcctttggacactattccataagacagagaaagaaggaaccctccctaattcattctataaagccagcatcaccataataccaaaacgaggaaaggacataaccaaaaagaacactgcaaaccgatatccttgatgaacatagatgctaaaatccttaacaaaatacttgttaactgaatccaacaacatatcaaaaagataagccaccatgatcaagtgggtttcataccagggatgtagagatggtttaacatatgcaagtcaataaatgtgatacaccacataaacaaaattaaaaccaaaaaatcacataatcatctcaatagatgcagaaaaagcattcgacaaaatccagcatccctttaagattaaaactctcagcaaaatcggcatacaagagacatacctcaatgtaataaaagccatctatgacaaacccacagccaacatgatactgaatggggaaaagttgaaagcatttcctcggagaactggaacaagacaaggatgcccactcttaccactcctcttcaacatagtactggaagtcctggccagatcaatcagacaaaagaaagaaataaagggcatccaaattggtaaagaggaagtcaaactgtcgtttaccttggaaagcctaaagactcctccagaaagctcctagaactgataaaataattgagcaaagtttccagatataagattaatgtacacaaatcagtagctcttctatacgccaacaggaaccaagtagagaatcaaatcaagaactaaaccccttttacaatagctgcaaaaattaaaataaaataaaatacttaggaatatacctaaccaaggaatcaaaagacctctacaaggaaaactacaaaacactgctggaagaaatcatagacaacacaaataaatggaaatacatctcatgctcatggatggatagaatcaatattgtgaaaatgaccatactgccaaaagcaatctacaaattcaatgcaattcccatcaaaataccaccatcattctgcacagaattaaaaaaaaaaattctaaaattcacatggaaccaaaaaagagcccgcagagccaaagcaagactaatcaaacagaacaaatctggaggcatcacactacttgatttcaaactgtactataaggccatagtcaccaaaacagcatggtactggtataaaaataggcacacagaccaatggaacagaatagagaacccaaatacttaaccgccaactgatatttgacaaagcaaacaaaatcataaagtggggaaaggacacccttttcaacaaatggtgctgggataactggctagccacatgtaggagaatgaaactggatccttatctctgaccttatacaaaaatcaactcaagatggatcagagacttaaatctaagacctggaaactataaaaattctagaagataacattggaaaaacccttctagacattggtttaggcaaggatttcatgactaagaacccaaaagcaaatgcaataaaaacaaagataaatagtagggacttaattaaactaaggagcttttgcaccgcaaaaggcacattcagcagagtgaagagacaacacacagagtgggagtaaatcttcacaatctatacacatttgacaaaggagtaatatccagagtctacaatgaattagaacaaatcagtaagaaaaaaaaatctcatcagaaagtggacttaggacatgaagagaaaattctggaaagaagatatacaatgctcactatcactaatgactagggaaatgcaaatcaaaaacacaatgtgataccaccttactcctgcaagaatggccataataaaaaaatcagaaaacagtagatgttggcatggatgcagtgatcagggaactcttctacactgctggtgggaatgtaaactagtacagtcgctatggaaaatagtgtggaaattccttaaagaactaaaagtagatctaccatttgatccagcaatcccactactggctatctacccagaggaaaataaatcattatttggaaaagatacttgcacacacatgtttatagcagcacgattcacaattgcaaaatcatggaaccaacccaaatgcccatcaatcaatgagtggataaagaaactgtgagattatctatctatctatctatctatctatctatctatctatctatctatctatctgatggaatactcctcaaccatagaaaggaatgaactgacagcatttgcagtgacctggatgagactggagactattattctgagtgaagtaactcaggaatggaaaaccaaacattgtatgttctcactgatacatgggagctaagctatgaggatgcaaaggcataagaatgatacaatggactttgggggtttagggggaagagtgggaggagggcgagggataaaacactacaaatatggtgcagtgtacactgcttgggtgatgggtgcaccaaaatctctcaaatcaccactaaagagcttagtcatgtaaccaaataccacctgtacctcagtaacttatggaaaactaacaaataaataaataagacactgaaatagatacagatttttttaaacagaacacaaaaatcaatgaccataaaggaaaagattgataagtatgtttatgaaaacacaatattacagggctaaaaagataagcattagtacagaaggaaggtatctgcaattcagaatacataaagaattctacaaatcagtaagaaaaacaaaacaaaaacccagagtactcaatagaaaaattgttaagacacttaaataggtgcttacccaaatgatatttaattggtcaataaacataaaaagatgaaaagtataagagcaaaacaaatgaaaattctataaacaaaaattgaatatcaaaaaaacaacatttagccaggtacagtggctcatgcctataatcccagcactgaggtttgcttgaggagggaggaggattgcttgagcctaggagtttgagaccagccaggacaacacagcgagatcccatctctatgaaagaaaaaaaaaaacatattcaatgggctggcagcagattgggataagagaaagaatcaatgaccctaaagacagagcaatacaaattatccaaatgaaagacaaaaataaaaaagactgaaagactggaatgcaacaccctagatcttggagctacaccaaacagtctaacatactatcattttcagtcccagaagttaaggagttaaaagagaaagaaaagaaaagtgtatcaaaacataaagtactcataattttccaaaattaaataaaaataccaacccatatattgaagctcattaatcccaagaaggatactaaacacatatagtcaaacagcaaaaactcaaagaggaaattgttttaaaaagcagccatgaagagtcataatgtatagtgcaacaagcataataatgatggtttctcatcagaaacaatgaagggagaagacaatgatgtgatatatgtacagtgccaaaaaaaggaaaaaaaaagaaaactgtcaacctagaatcttctatctgttgaaaagatcattaaaaacaaagttgaaataaagacatgctcagatgggcaaaagctaggagaaggtctctagcagaccagcctgaaaggaagttcttcaggcttaaggaaaatgataccagatggaagctcagacttcagaaagaaataaagagcactggaaaggacaaatatgtgaataaatataaaacacaattttctataatatgtatgcacatacatgcatacatatgtataaatttctttaaaagaccattggttatttaaagcaaaatggacccaatatatcatgaagtttatagcatatgtagaagtaaacaatatgacaacataagcccaaagaatagcagaaataaattatataatagtaagattattctattgtttgcaaatttggtaggaaattatttgaaaatagattgcaataaacttaaatggatatgtaaactctagagcaaccactaaaaacaataacataaagagtagagctaaaaatgtgatagaaaaaataagaacatatattctattcactgcaaagaaggaaaagaacatatgagactaacagaagacaaataccaagatggtagacttaaaaccaaccatatctataattacattaaatgtacatggatgaaactccacataaaatgacagagaatttcagctgagcatttaaaaagccagacctaattagatgctgcttacaacaaagactgtaaatacagagagagagagagataccaagcaaaaacaccccactcttagtaaatgacagaacagtggacaaaaattcagtaaagatactgaagatccagatattataagccaacttgacctgtcatttttagaactctatactccacagctacagaatatacattcttttttttttttttttttttttttcaaatgcacaggggaccgttaccaaagtaaagtaaatactgggccattaaagaagtctcaatacatttcaaaggttagaaatattacagaatatgttatcgaattacaacaaggctaattagaaatcagtagcagtaaggttttttaaaaaaaaaaaatccctaaatctttagaaatgaagttatatactccataataactcactactaaaatattacttcagaaagtcaactcatgggccaggtacagtggctcacgcctataatcccagcacttttagaggctgaggtgggaggctcacttgaggccaggagtttcagaccaacctgggcaacatggtgaaactccatctctactaaaaatacaaaaattagctgggtgtggtgatgtgcgcctgtaatcccagctattcaacaggctgaggcacaagaatcgcttgaacctgggaggtggaggttgcagtgagccgagattgcaccactgcactccagcctgggcgacagagtgagatactgtctaaaaaaaaaaaaaaaaaagtcaactcataaatattctgaactgtagataatgaaaacacaacatatcaaaatcattggatgcagctaagcaatacttagaggaagtataactttaaatgcatatattatgaaacaaatgaaaaccaacagattaatgttcaatcttaaaaagctaaagaaaaagataaattaaatcaatgtaacttaaaaaatataagaaattaatgaaatagaaaatctaccaactacagagaaaattacaaaatcaaacatgaattcactggaaaaaaaatcaaaattgataaactccaagctaaactgattgacagaaacaaattatcagtgtcgggaataaaagaagaaatttcactatagattataaagacattaaatggacaaatgtgagattatgaacagtttcatgcaaaaagttctccagtgaagacgaaataagcaaatgtattaaaaaccacaatttgcaaaacaggaaatattcacaaatgcctaatattaaacatatacaaatacacttatgtatattaaaaactaaaaaatcaacaagatttttaaaaacacgttttaaaaagctggcaggagatctgaaccagtatttcagaaaataagacacttgaatggccaattagcctgtatggaaaaagctcaatattaatcatcaaggcaatgcaaatggatcatctatactctactaaaaagaataaaaacaaaaagattgatcatactaaatgttggcgaggatgtggagcaactagaatgctcatatattgccactgggtgtgtaaaatagtacaaccattataaaaatccttgtcatagtttgatttttggtttttaaagtgaactttacgaacccagcaattccactcctatgcattttatctgagatgaatgaaaacatatgtagtgtacccataaacacttctataagaacattcattgctaaaaactggcaacaattcaaatacccatcaatcagagagtagacaaataaatgttgatgtcatcatacaatgaaatatcactcagaaaaagaaaacaaagaaatgaaccactgaaacatacacagaactcaaaaacatggtgaacaaaagaatccagccacagaaaaattattggttccatttatacgtagttcaagaacaggaaaactaattgatgttgacagaaatctggaagaggtgtagaggtgtgaaaattgactgcagaggagcaaaggagacttcctgaggagatggaaatgctctacatcttgttttagagggtggatattggaatgtacacaattagtaaaattcaacctaaaaaaaactgtcgattttattgtatataaactatacctcaataaaaatagatagggtaaaaaaaatatgacactagaatttcattcccatccctttggccatgttcaggcagaggttgggcagtgtatcaatacacaaccataacgctaagagatgatctcctcaggtgcattgagggtgggaaagggcaaatgtgagaactaatggtaaccagcccatgtgccctagaacaaaaatggctcctgatccatgtttgatacgtgtcccataggtggctggccctttgctgcgatgcacaagcggcactatcggcttcatgactcaacgcaaatgagagagaacactaagtcaatgaacccagggaaagggctgaaagaaaacaagtgagtcacaaaactcacaagtagaacagattacacttacccatgccccacatcagatggaagtgatacatccatatagaaaatagtgactgcaagattttaataaaactcaggcaagttctccagtccaaacctttttttgttcatcttatcaagaaaactcagtaggtatacagacaaaaatgaatgtaatcaatcaagaatagcatagagagaatttaaaggtcctcaattaagtaaacatttggccattttcctctcctgggtaatagctgtccattttatcattactaaggatgcaaaatgacaagaagagaaagcaccacgaatggccactattgttttgcaatggacatcatccaatatgccagaatggaaagttctatgctctgctgaataccaccagacttgataaaaatgagactcttaatttttttctttaggtcttaattagcttcttgttaaactacaaacattatcattggaacacacatgctgggaaaaattggaacactggttgccagcctgggaagcctgggagggtccccagtgattaactgtcaccacactaatggtgacagtactgctttctacatgtgctatcacactggaaaaaacccaaccattgcatctttcattaaaaaagaaaaggtaaaggaattgttagagtgggcctgtgtgaatcctatcatcctgatctcagaaatccaggggtcaagagttggcaaatatttccagtaactcatgtcatcaactgccctgtctattaacaaggaaatccactttaatgtggcagttggcatgaatcattatctctagggctggcattttcacagactagtccatccttgtaaatgcagtgactaaaactcttttgttgactttgaaagcatgagaacgccgtgattcagttaaaatggatgagtttacttttgaaagactcagtaaaacagagatctttcaaatgacggcaaggcgacctaactaacgatctcttttgtccaatggggatttgagggtaggagttgggggaaggggtgaacaaacctcagaaatctcaaaatgacaaagtcattgttcagtgtgctttctacacactttccctgacatctctacacaatgaaatgtaagggtcagtggtactgagacaagtcaaggcagttccactcttttgcttctataaaagcgagtgacccaacctattatactcaagtcttaggatggctttgttctccacatccagatgcagcagctttttctcctgcccctcatcctgccctcccacccccctagggaagaaatgactgaggacacctccttcacattttctttttcttgggcatttcacttcataaagctgcagtcaatgtgttttgtttgtgggaggagggactggcacattcagtggtggtctccactgctgcctgcattggtggctcaagtagcctcaggactagtcctttgtgttccatgaaaggatatgaaaagtcagttatttaagctcagtcaagctgctgatttttttttttttttagatgaggggtgtgtagggaagaaaggttttgcaattccgtgtgcctcaatatattacagtattttgctgagtgcagctgtgtgcaagttagcacactcggagcactcccaaatttaaacagaaaaaattaaaatgcctaaatccaacctctgcatcttatcttcatttttcatttgtttttttctagtaggaagacttcttagaggcaaagattttagctagcagaagtctagataactcagactctacactcaatgttatcaagggccaaggaagtttcagcaatattatgaaaattacgttattatgagatatttagtgctcactggtttattctgaaaacaactgattttgatactgtggttccagaagagaaaatagccattaaagccttcagggataataaacctaatatctggaatacaaactcatgtcctaatacttatgggtctggtaactgtctgacaattaccttaatgcagcataatgtcattgtcaggctatttctcccacttaaaaatatacgtagtatttaaaaagtaccttttatttagtgagcttagatgttatgctaagaatgttattgaaatgacttcattttatcctcacaataaccctcatggaataggtagaattttctccattttacagagacgtagcatgtggctttgtgaggaaagagaaggtaagcggtagagctaggagtcaaacttaagaaggatgattccaagcctctcccattccatcctacactacacttgaaattttttattattattttttggttcttttgagtctgggtctggctctgttgctcaggctggagtgcagtagcacaactgtggttcactgcaacctcgaacttctgggctcaagtgatcttccggactcagcctccagagtagctgggactacaggcacgcaccactacacctagctaattgttttatttttttgtagagacagggtctcaccataatgctcaggctggtctcaaactcctgggttcaagagttctttccaggtcggcctcccaaattgctaggactacaaccataagacaccatctctggcaaagtcttttattatttttatagagaagggggtctcactatgtcgcccaggctggttttgaactcctgaccttgagcaatcctctcacttcggcctcccaaagttctgggattacaggcatggaccaccacacctggcccctacattatactttgaagttatttacttacaagtgatatctagtcacaccttttttttttttagatcgagtctcgccctgtctggagtgcaatggcacaatcttggttcactgcaaccactgtctcctggattcaagcaattctccctgcctcagccccccaagtagctggtattacaagggcccgccaccacgcccagctaatttttgtatttttagtagagatggggtttcaccatgttggccaggctggtctcaaactcctgacctcaagtgatccacccaccttggcctcccaaagtgctgggattacaggtgtgaactaccacacctggcccagtcacatctaatcttattcacagtagcacactcaacactcacacctttaaaacctgaagctgggccgggcgcagtggctcacgcctgtaatcccagcactttgggaggctgaggtgggtggatcacgaggtcaggagttcgagaccagccgggccaatacggtgaaaccctgtctctactaaaaatacaaaaattagcctggcgtggtagcatgcacctgtagtcccagctacttgggaggctgaggcaggagaatggcatgaacctgggaggcagtgcttgcagtgagctgagatcacgccactgcactccagcctgggcgacagagcgagactccgtctcaaaaacaaaaaaacagaaaacaaaaacaaaacctgaagcttttcctagagaaccaagagcacttgcaaagggaattttcatggctctgatatcctgaggtagaatcaccctaaacagaccacataaatgatgctggcttccttttaattttggaattgagaacagctccaattttgcaagcaactataatttgacaggattggcaagatatctgacagctttaacagttgatctagtaaagcattcacggaggtgtgcaaacctaactggccttctactgggacacagccttgtgaatgacacatgcctgaggggatcgactatcctgcagtgtgggccccctattcagaagcaagggctttcattagccacacaaggcattctgacctggatgtcctaaagagaaacttgtccaaaccagtatcctttcttgttttcctgatgctggtacaaccccatctttctgacagtctcccattcctctccatatccttccacccaaatctctaaactctaaattcctgtgcttaagaaacaagccttcttgtgatctggcccctctgcatctctccatctgatctcctctaatgccttgtctcaaacctcctgatgcagctattccacactgcagtgtccctgtagatatcctaaactcctgcacttcctgccatatgtgcctccttctcccctacatggctcaggaataaccaggaagccttaccagcttccccaagcagggcaacagacaaagccctttgctgctgtgatgtgaacttgtatttggccagcatggaaataagggatacacaatacaaaatccttaaagttggttttgaggtttttttggtttgggtttttttgttgttgttgttgagatggagtctctctctgctgcccaggctggagtgcagtggtatgatcttgactcactgcaacctccacctcccatgttcaagcaattctttcagcctcccaagtagctgggattacaggtgtgcaccaccactcccagctaatttttgggtttttagtaaagatggggcttcgccacattggtcaggctagtctggaactcttgacctcaagtgatctgccctcctcagcctcccaaagtgctgagattacaggcatgaaaaaacatgtccgggtctgatgttggagattttcatggtctttcttatgtatatatcacacacataatacatcatctatgaattttaagacacatgtgaagctattagcacacaatcctattttcctccaattctcatctccaccccatttattctcatccacacataatttgttaacaattttttaaagtgaagatttctttcccaaggcttcgacttgtcaaacaaatctttcttgtggcattcctgtttcatcagtttatatgataagtattgccatcacaaaattacagtaacaaggataagtagcatgaatacgttgaggaagaatcacaactgactctgaggaagcataatgaggccaaggattggggcagagaatggggtccgccagaggcagcccagtggcaggcatgtgctacaggtggagtggagggtgctgtgaatccagaaggtggtgaaaacaaacaagtggattagaacacagtcctcaacctttttggcaccagggactggtttcgcggaggacaatttttccatggatggcgatggaggtagtttcaggatgattcaagcccattacatttattgtgtactttatttctattattatgtggtaatatataatgaaataattatacaacttaccataatgtagaatcagtgggatccctgagcttgttttcctgcaactagatggtcccatctgggggtgatgggagacaatgacagatgatcaggcactagattctcataaggtagatgcaagctagatccctagcatgcacatttcacaatgttcacagggttcgtgctcctatgagaatctaatgccgccgacgatctgacaggaggcagaggtcaggcggtaacgtgagtgatggggagcaagctttgttttcttgtccaccgctcacctcctgctgtgtggccaggttcctaacaggccacacagactagtactggtctgtggcccaggggttggggaccactggattagtcaacaagagtagttgttcacttcttcatcctccctagagcactaattagcaagaaaattaaagaataaatttaacatttacccctggaggttcaaggacaagttagaagttaataccttaactttcagtttcactcaaatgtgcataaagctccattagtgctgctattggtttcactaactccatccacaattctcccgaaaacagaaaacctcatacaacaaagccaaacctgaaacacaatcaggtttccaccaggcagaagtatggtgactaagcctagtggcctcggcactgctggacactgaattgcaatggggtaagtgaagagttccaaagccaagggaagcctcccaacagcatagcttggaatggagtgatctgctgtccaaccccaagatgctgatgcagatgatgatgataacagcaagatagaggagacatccactgccacaaagacctttttcaggtgaccgcaaagagcagggagaactctgaaaacgacccttttcaggaagcaaccaggcacaactcagaggacaaccaccacgtgtgcacagggtaagccggttaccggcctcgctgattttcagtaaagcccatcaactgggaataacgtctctaaaggagagagatgcatgtgcacacatcacacatccttgtttaaccttaaaattacaagatgagctgccacttagctgctcaaagaccttagaggggttcagctctctataggttcaactatgaattccatacacaagtttacaaggctggctaaaatgtagactccgactgccctagagccctacataaatcatctattacagccacaaatgttattttcctcaatttacagtttaagatgggcatcaagctactttaattggaagattacatatcaacggtttaattgcttcttgaggggtatgtgcgtgtgtgtgcgtatatatgtgcgcgtatatatatatacatatatacgcacacacacgtatattttaaccaaaaagtaactaaggcaggtctcaatcgattagaggtttatttagccacagatgagaatgtggcaggggcatctgtgatgcttttttctagagggagttttgtaaacttcagtatttaaagaagagcaagcagaagggaaaaaaaaataaaaaaaagaaaaagggagggagggtagacagtgagatggtcaccttcttgtgagaccctgattagccccagtatatctacattttacatgtgaaaagagggagtagaagaaaatgtggattgtgcattgtctcacactcagtcgatctgtattttatattaagataaaggagggagtacaggaaatgaggcagtgacacaggatagtagggttgtgaaatcatggctgtttgggaacaaaagaaagatggtactggtgactctgttcccaagcttaactttccctttggcatagggagtctgggacctgagattctatttctctttcacacatgaaataaggcacccagactttgttgtctaaaatcaaatacatggggctgtgggggagttcagatcctttacagacagtttttaagagtattcaggctgggcgtggtggctcatgcctgtaatcccagcacattgggaggctgatatgggtggaccacctgaggtcaggagttcaagaccagcctggccaacatggtgaaaccccatctctactaaaaataaaaaaattagccaggcatagtggcagtcacctgtaatcccagctacccgggaggctgaggcaggacaatcacttggaacagggaggcagaagctacagtgagccgagatggcaccattgcactccagcttcggtgacaagagtgaaactcctctcaaaaaaacaaaacaaaacaaaactagagtattcaaagtataaattgtgacagaaacattccatttaattaaaccatgaggtgtttttatttcacaaaaatatttatgctgtgtactgtatatgtttatagtatttaaatttaactctttagtatacttatgtaactttctataaagaatgcacttccagtgaataatattagtacaatgtacaatcaccagttgttacaaagttttaatgtaaagttattttttaacagtaactatagaaatgtgcctttgcttttgccacagttaattgtttttccttgtttatacagtattaccacagagctatatatatcacaacctgaacaaaggtgcatcagaatactgtagataaagatataggctgggcatggtggctcactcctgtaatcccagcactttgggaggctgaggtgagtggatcacctgaggtcaggagttcgagaccagtctggccaacatggtgaaaccctgtatctaccaaatatctaccaaaaaataaaattagccaggcgtggtagtacacacctgttgtcccagccactgtggaggagtctgagatgggagaattgtttgaagctgggaggcaaagtttgcagcgagcagagatcacaccactgcactccagcctgggcgacagagcgagaccccatctcaaaaaaaagaaagaaagaaaagaaaatctagtgtcctctctctcctgagcttccagatgctcatatctaaaaaacagtcacagtttctctggtacctgggtttgagaccaggtttatcataaaaccaggaataaagttatttaaatgagtagtctccacagctgggaatcttactgaccactcaaaatgtctaaaagaattttggggaaaggaaactaagtttgtctacctttaattctaaagacacagggggtaagaaaaaaaggctagtaccacaatttctgaaaggtttatatctaaaatatcataggctcatattaaatgagcattatatgactttctatagggagatgggtgggcaccagatgacaaataatctattattagagacttagtgatagatatggtttggctgtgtccccacccaaatctcatcttgaactgtatgtagctcccataatccctacatgttgtgggagggacccagggggaggtaactgaatcatggggttgggtttttcccgtggtattctcgtgatagtgaataagtcacatgagatctgatgattttataaacagcagttcccttgaacatgttctcttgcctgccgccatgtaagacatgcctttgctcctccttcaccttccaccatgtgaggcctccccagccacatggaactgtgagtccgttaaatctattttcttttttttttttttattttattttgagacagagtgtgtcgtccaggctggagtgcagtggtgcaattttggctcactacaacccaagttcaagtgattctcctgcctcagcctcccaggtagctgggactacaggtaccctgctcatgcttggcatctctctgcctgaggaaatgccactttgttcccttctggagacctggcacctgttcctcctccatacaatgtgcccctccctcaacctgcccccatatcttctttgcacggctgtttccttatttttcaaactcaacgtcacctcctccttgactatgctggtccagtcattagcaaacactttcctttgctgaacacactagacctatactaacttagattatttatgtttattggtctgtttattgtcgacctcctgcactagaatgccaattcctagaagctgatacccagttaactgctccatgctctagatcctggaaaagtacttggcatacaggaggtgtccaagaaatactgattgactcaacgactatgagtgaagtttaaatgagatggggcaagtgaaatatgctcagagcagtgctcagcctggtgttatatgatcccttctttttacaggacctagagattgttttattacagaatggagtggtaaagaaaagcatcactaatgcgaaagagagactttcgctggtccttaaaggatgaagaattagaagggtacatttgagggtgagccacaggtgtgcaaacacacacacacacacacacacacacacaggtgccaacagtctggcatgcacatagtttctttccaaaagttaaagagagattagatttaaggaccagaaaatttgaattttgctctttgtatgtcctttgtagccacaaatcaaaggcaagcaaagcaaaacaaatctatttagatatttattctaacatatggctgcactgtgagaagagggtttgagtcctcactccagcattaggtgttgcatggccagtcttggaggaagccataattgaacttaaagtgaaagagctaggattggaaatttgtctcgtgctgagaccttaaccattctctcctacagtatcccttctattgtaagtcttatcacacagcatggtaactgctttctatctgtccctcccaatagagtaaactcatagaagaagggaattcaatttcacttagccccatatctccaagcccaacatggggcctagtacacccaagatactcaataaatgcttctcaggtggatgaagataaagcctctatcttttccacctctgcatactcagcatatagtaggagctcaataaaaagctggtgggaaaaaaaaataaaaaggaagacatgtaataagaatgacacgtattggccaggcgtgatggcgcacgcctgtaatcccagcacttttggaggccgagacgggcagatcacttgaggtcaggagttccagaccagtctggccaacatcgtgaaaccccatctctactaaaaatacaaaaattagacaggcgtggtggtgggtgcctgtaatctcagctactcgggaggcggaggcaggagaattgcttgaacccaggaggcggaggttgcagtgagccaagatcgccccactgcactccagcctgggtgatagagcaagactctgtctcaaaaaaaaaaaaaaaaaatgagatatattgaaaagaattacaaattattttcacaagtcacatatttgtaatagaaatgttttccttttgggagaaactttgagatattcccagatacatccagttgtaaatatagtcacaaaacaccatatctccccatcaaatactacaaataaatttgcactattaaaattgttgaaaactactgattccaaatcattaatattaaatttctaattaaaatgctaataagatattattaatacaaatattacaggtagggtacctattaatccaattattgttttaagaaaatggaagaagagattcatgatgctggcattggtgctgatattaggaagtaatcaagcacttctggcccagcgcagtgcctcatgtctgtaatcccagcactttgggaggctgaggcagcaggatcacttggggtcagaaattagagaccagcctgggcaaaatggtgaaaccccatctctactaaaaatacaaaacttagctggccatggtggtgcacacttgtagtcccagctactcgggaggctgaggtatgagaattgcttgagcccgggaggtggaggctgcagtgagctgagactgcgccactgcactccagcctgggcttcagagcaagaccctgtttcagaaaaaaaaaaagaaagaaaaaaaaaaaaaaaaccacagaaaaaaaggaagtaatcaagcactttaaaatgtgaatgttgactatcatctctatgtttttgtttgttgatttacgcaaacatactatgttttgaatgccaaattcctattcaaagaacataagttccagatgaagatctttatgctatttgtatttcaattctttatgaaaacaagatattcacttttaacctgtgaagagccattctatgttcataaatgacttggctttagaaatattgtagatgttcaaagctgttacaagttttgaaaaagcagacaagaaaaacatgtttgaacaactctttataagccagatgtgcactgccagccttggctaaattatctgattagcccatggcaaccttgaggtaacttgcagactgttcatttgtattctataagttatttatttccagtgatatatttatatcttatgatatattcaaaaacttcccttaattctggctttccttccaaaaggcctaatcaaaaacctcacctttctttattcactactgttgcacacctgagccaatctgagttccaaagtgacacattaccctcgctgcccctctgggtttcttcccttaatacaggacagcaaatgacacccacttttaagttaccagtgtcactgttcccatctgcaatgagtgccaacatctaactatataaaaacaaatgaaaactcacaaatacaaatattttattgaagtccaaaaatcaaagttaggttaattgcctctatctggccagcaaatctggtcacatgtaaaccagaatttccttatctcagcgatttcatcgggagagtaataaaatctgtgcatggtttcagacttgcttctacagagcctacattctagacaccaagccacaagcagagggttctcctctcagatctacccctccagtctttggcaaactcaattggaaacagttcagttctgacccaatggtccacagttccagactcctacttacaaaaccaataaaacgatcaccatcatacagaaaacgtaatcaaacatgaatgctctggattaaaaaggtcacatgaggccaggtgcagtggctcatgcctgtaatcccaccactttgggaggccgaggtgggtggatcacctgaggttaggagttcgagaccagcctgagcaacatggcaaaaccctgtctctactaaaaatacaaaaattagcttagagtggtggtggtcatctgtaatcacagctactcaggaggctgaggcatgaaaatcgtttgaacctggggggcaaaggttgcagtgagctgagatcgcaccattgcactccagcctgggtaacagagtgagaccatctcaaaaaaaaaaaaaagaaagtcacatggataaatgcaactacattatttatttctatagctatttgattttaaatctcagctttagtaagaataacaactcgacagtcttagtctgaatgttctggtaagtgtagaatttcaactccctttttatgaagatacctaacttttctgtggattttaatcttcattctatttgttactatacatcctgccaaagttctttctggctcaagaataccatccgtagttggttctgatgatacgtagttcccctgtcgatcagtcagctagataacaccaagggtaacatcttgacaaagaaatttccagtttttttaaactcaattgtttcagtcaatctcagctgctgggttgagaaggcctcactttctgtgagtttctctgggcttaggaggaactgctagtcactgtgattattacctattgaacctaacgagagccatcaaaacccagggcccgtgatgtcagcagcatgtttattacccatagaacctgatgacagccacaaaacccagggccccagtgtccgaagcatgttttgctaaggatgttaaacacaaagtcatccaggaaatttcctactatctgaattttgaaaggggctaaataaaccctgtagaagaattgatgcggtagacgaggcctaaaattcaactccatttcagatgcccatgcaatggagaaggctactatccacacagataacatcaggcttcctgtatggctcaccccactggctctagaaataaattttaaaaatgtatcacagaactgagtcaaagtagacaaaatttcctttgcaaaacaaaacacctccctccttcccccctaaaagatcaacgactttaagcaaagccatgaggtgaacaaagctaactgtcattttgaccttgctttgctttaattcaggagactacttagaaatgtaccgagcaacccccttcattcggctcagctagcagagctaataggcttctaattaatttccagaagattgctgttataactaacaggttttaaacatttggttgattggggaaaatgaattgaatataatgtatttgatttggaaaattagttttcattctatgtgcttaccataatagtgtttattttaagtttacatgattccattaagagtcccagaacagcactgggctgttttcatccttacagagaggcctaggcaacttaaaaaaaaaaaaaaaaaattacatttagatttttgttggcctttatttgagggcaggttaaatgcatttttttgggtgggtggctttaataaaaattttcacttcctaatatagcaacaggcccaaatactttaaaatgatcctggcgatacctcagtcaaaagcccactcatcgaatgcaaatccccgggagaaaggctcggcacacaaagtaagatgaaccagttactgcattgtttaccacgtttcacttgattcttcctgacaaccatttaaacaatgaatgttgggaaatgtccctcaaagaatcaacaacaatggcagggaccagagcttttatatttagctaatactatttttaaaaggagaaaatatttcttcctgaagggattatgggaagccttattaaagacacctgcaaacaaaacaagtgacaatagatctttatcataattgataactaagttatcctttagataaaactcctttcttggagacaataacattaggatttaaccttcgctgtagattcaagaaatcagctaattggggccagtaggattccacaacattaagtttaccaagattatgtgagtggataataacaaacgcccttgtctctctggttaaatagaagtacaacgagactagaattttccctcctcatgcttctaagaaatgttttatattgacatcaagtagcatccatccctctccctccatatgtgagacaaagcacataagggatactaattacgaccgctcactctgctaagcacatagtgggccagccagcttcggaaactcaacctttgcctagcttcctgttgcaaagaaacagaaactttcacaaaatcttcttgaagtaattaacaatccctgtcaaaacgtgtacagacaataatctgcattctatgtaaacggggcaactgttttagtgatggcttctgagggataaataatatagctaaacccaggagggcacattttaaaaatgtttgcaaaagaaaaaaaaaaatcagaggtccttgtttgcagtaaaaataatccacctgtgagtctcagcttacttcacctccataaacagtggatgccttcgcccatgggctatactgtttgcagtcacatgctcatttgctgccttgctgtgtgacaaacaggaattcctataagcatttcaagcctatgactgatttttcttacatagctaattttccaaattaagtaattttgcttcctttataactgtggctccagaggagatctaaagcatctgagcattgagaaaaaagcaggggtagggggatcacaggatcaagccaaaattgcagaccccaactgtagtatttctatttaatggctttaaattcagctaatgattacaactattctaagttggcacttagaaaaagtcacagaggttcaaatttcataaagtgttagcaacagcagctgagattttggaatatgtatagcttttaatagatgcatttccaaaataaacacttgggaaaaaaaaagtgccccagcttgaaccactgacaagtagacaaaattaaacaataggaaaaaataaaataaaaccaaaccacatgagcaacagtactgaataaggagatgagagatgacccaatattattttttagagcctcaagttcacaaacaaaagaaaagttttacagaaggtatttctgtaggattgttggttttttttttttaaagacagcttaagacttagagcaatcaacgtgtgaaaacaaaaaagacattttctgagttgactttgatcctgtactcaaattggcttagatatccttgcctttaaaggctttgtatccgcaataactgctctctattgtccttgttaataaagtattattttcaccttattattactaatcttttctttgtaagtaaccacacctggttctatccaaaaaaaaaaaaaaagtgcctaagtatttgccctttgtggtaatacaatgcataatttagttaatctaggctatctttccgtgagaggtgattgtttctgtattatgaaatgtgttcacagtaaagcaaaatccacgccagatacctagaggcagacggagagccacttaccaagcacgaagctgcttcaaactaaccctgacgcgactgtatagccactcccacacacaaggtattactcatgccaacttagcctctgagttataaccgcacctttcttttacaaacatggccctttattaagttaacattacacacagccaggccgagagtcccacccccagaccccatgaaaagggcttgaaaaaataggaacttccgttttccatttgagatcctgacattactctcaacgttacctggatgaaatctaaaaacgtcagcggcagcaaatcatccaagtgtccaatgtctttggagaaacgatttaaaattcttcctgcaagaacaggatatgaaaaattactcatttccccagatagaccctttaagagaaacaattcgcaaacaaatcaaaacaatattttaaatgcatatgtatttaatatattattcatatgaaataagccgatgtcagtggtaaagaaaaagaaaataggacgatacctaaagagaaacaaaaatatcatcaaatggcagcgggcagggagttgaaatgtggccctgattttaaaagaattaagggaaaaaaatcttgtgacagtatcaggaagggttggtgggttctagaatgttccctccttttaagacccaatctaggacttccatccaagtgcaaagtaggtagatgaacgtacagaaattgatcctaattatttcactaattttgctttatcagaatttcttttgctaagtggtatattttttatataaacataatgataacctctgtatttttttttccccagcctgcttgactgtacctcacatttttggggaaacttgggatcctatcattttccaggctgtgagtttactactggcaaacaagttgtcattttcagatgtgcaaacagtatgacaaaaacaggcttagtcttatctaagaacacaagaggaaattatgcaggaaaacagaaatattatttaatgactgaagatcactgcttagcatcgactttatttcccgtcaagtagaatccaagaaaacagtatgtcataaaggcatcacaaacagatcaaacctggtttctaataaatatctattctttcaaatgatttccttcaaaaaaatggaagctatacacacatagcctacgtggatgcaggtgacccctgagaagtgtgtgtgtctaggcctctgaacttcttttctaatcaacgcttccggaagccctgcttacagatgagatgtgtggcctcctagggtttgtcaggattgacttcgtcctggggcctttataccaggctgcaagtggaccatgaatggtcagaggctgtagacggagctgcctcccgctgctggggctaatgcagcctctgcagttctcctgaggcatccagctggccaagaagcacagtgtgtacaagttggagctgcacctcaattttcttgtctcaggcttcggacacacagactccagaaagcatcattcagtgacacctttggcaggcccagtgacaacttttctgagcctctaataacacctcctctagagggttgtcctagggattaaacgggctcatgcctgttaaaaaaaaaaaaaaaaagcccaggcacaacgccaggtactttttcatggctgctagaaaaccaaaaccaaaaaggtgcgatgatgactatgacccacaggttctgcagcatgccaccggggaggaagctcaacttttcaaatgcaggtcctgatgcagtggccctggggaggagctggagcctgaatttccaaccagcttccgggggcccttctgctgtttgccagaccatgctatgcagggcaagaggtcaggctattattttatcagctatacttaagaaacattaaaattaaatgagtatttttccgacagatacttatggattttgtttgtcgtccttcttgttattttttctcatctcagtgtatcaataccaataaaaggaaaatataagttaaaaaatttaagacataattattaaaatatgaattatttcttaagtggaaaagttaacataggcaatattcagaaacattgcaagtatggttcagcttttaaaaagttgaaagcaatattcaaattaaaaaaaaaaaaaagataggccaggtatggggctcacacctataatcccagtacttctgaaggcagaggtgggagcattgcttgagctcaagagttcaagaccagcctgagcaacatagcgagacctcatctctacaaaaaagaaaagaagaaaaaaagataaaaaggctacataaatcattagtatgtgaaaaccaaccctttatcttgaccatttgggagcatcttaaaatctgaaagacccatggttggaaaacagcataaaatacaaggaaaacaaaaacaactgagaaagcccacctcctcacacagctacgccaataactgaactgaatgtcaaagatcagctgaaatcaaaactcttatcaacaatgatctcagtgtagaaagtgtaagattagaaggttcaatagttacttccttgttctaagaaacaattcaaagactggtgtttgcaaaaagaataaaagttttaatttttttttttttttgagatggagtctcactctgttgcccaggctggaggagatctcagctcactgcaacctctgtctcctgggttcaagtgattctcctgcctcagcctcccgcgtagctgagattacaggcacatgccaccatgaccagctaatttctgtatttttagtagagacggggtttcaccacgttggtcaggctggtctcaagcttctgatctcaggtgatccacccacctcagcctcccaaagtgctgggattacaggtgtgagccatagcacccggccagaatattttcatctggcttcgcagtaaactgtcataatcagagctgtgatgtcaagttcacagtctcacagtcattttcccagaggtctccaaatcaaacacttatgataaattccctccatgcacatgccacacctcttcatccaaatgacatctggcccctgctggagcatctccagggatgtcgagagaagaggagtcactgtttcctgaggagacccaatctattttcggactgttctgttagacaaggcttgcttacattaaaccgaatcttgccttccgggaacatccaatcgttgctgctgattctgcccttacaaccatacaaagtgaatcgaatttctcttgacagggcagctcttcaactacttgaagaaagttaatcacaagttttccagacttctcacaggcacctatcccttgggtacctcaattatctctcataacacacagggtcccatgttggccattgcctcagcacatagtcaggtagccagcctctctgaatgcctggtagccaggattaaaataaataccctaggtattatctgcatatctcagggtcaggatatatcccatgactaagcccacaatcacagtaaattctttgagccagaccacattttggactcacatttaatgtaaatccacatcactccaatcctgcatgatggcacaggtagatttttgggagctggacaataaacaactattgagtgcatccccacggaccccaaaattcaattttataagaagtatctcaaggcattaataagtgcatcaaagatggtcaatgtggcattatttggtaaatcagaagcaggaaacaaccgaaatgtctgaaaagggtctatattaagttatgagcacactaaaattttcctctgagagagagagagagagaaaccaagctcctttgaagtcataatatcacatacagagtcaggttgctcctaacttttttccacaacatagaatattataaaaggtgttaatgaactttttgtcaaaatacaaattcataaatgactctattttacaaactgattctagaatctaatctgaagttaaagtcacctccggaattctgatacgtctcccatgacgaagacttcccaattcccttataaccgtactacaatttaaaacttgtaagttcccatgtctactgtgagccccattcttttttgtaacaaaaaagtacacttaaatatgaagatattgaggcatatttgcattgatacatattttacgtctcataaaactcatccatttcaggtatccaattcaatgaattttagtaactttactgagtgatgcagtcattaccaaaaataagtttcaagacatttttatgcccccactaagatccctcatggcactcacagtgcctccctatgcccaccccagcctcaagcaactactttctgcctctttgctttttcagtatctttcatggaaaaggaatcacacaatatgtgatctcttgtgtctggcttccttcccgtatctcaagattttgaggttcacccatgatgtagcatgtgccactcattccttcctggtaagcccattctgtaccacaaaaatggtcttaggtgccacatctgaccttgaaggtaaaagtagatgtgtttagtgaactcttcaattttgtaaacttctttataggtatccacacttatagcttcactgatggttctgaaaactaatacttttgataagaattggcctttgagccaggcgcggtggctcatgcctataatcccagcactttgggaggctgaggcaggtgggtcacgaggtcaggagttcaagaccggcctggccaagatggtgaaaccctgtctctactaaaactacaaaatacttaggtgggcgtggtggtgggcgcctttaatcccaggtacatgggaagctgaggcagagaattgcttgagctcgggaggcggaggttgccatgagccaagatgatggatgctactgcactccaggctgggcgacagaacgagactccgtcaaaaaaaaaaaaaaaaaaaaagaattggccttagatattcctgcagagaattggaagccagaagtacagagagagggtggaccctcaggtacccatagttgatggtaggtggagtgtgcaaagggcaaaggtaggatgggggaaccactatcttgagatgtgagaagtagaatgtaaatgcaagcagtctgtcccaaagagcagagtctatcaaatggtgtcgagagaattgacctgtgcactccaggtacaatgtggtgccacatggcggggcacagactggtccagagtacaggctgttgggtggagcctggagacagttgctgggctgaaaaggatgacagcatctatgacactgtgatctgggaggggaggaagccatttgaggggatgggccagcctggacatcctgtatcactcagcttagaccaaaatgagaaccaaacaggagatctagaagtccagtatttcagtatatctcatcagaacaggccatcaacatggcagaggctcacagaaggcatgaaagagaaaatgaggcagggacaagacatgaggtacttatcctcctcggaggctcagtagcaacaggactcaacaatacagggcaactcacccaacctatactgacactcaaattcctgacctataaaatggagctgatgatatttgcctggactacttcacagggccaaagatcatgaggatcaaagagatcatgattatgaagggatcttctaaattctagagtagctcacatgggtgagacattctttgtattattattgtaggattatagagcttaaatgggtgcgaaggatccccagggctgataacattcaaactttatggggtttttttttgtttttttttttttgagaaaaggtctcactctgttgcccaggtcaaggctcactggagccttgacctccctgggctcaactgatcctcctgcctcagcctcccaagtagctgggacctctggtgcaccaccatgcctggctaatttttaaatttttttgtagagatgaggttttgccatgttgcccaggttggtctcaaactcttgaggctcaagcaatctgctcacctctgcctcccaaagtgctgggaatacaggcatgagtcacagcgcccagcctcaaaccttgtcttatgaagattctgagactgccttgaagaatcttaaagaatgagacagaggatgaagaggaggccaagcacacccaaccccagacacctcatctcctcccttctctgcccttcccctctcaaacatagggccttacatccattgggaccttcacatagagattgcctctgaagaaaggtttctgcaggcaacagaaatgttcacagcactttgtagaccaaactcctcatgttagagatgtgaagacaaaagccaatcttgctcaaggtgatgcagtgttttctaatgcggtgggaactctctgccaagccattctgggatttccataaggcagagagaagaggaatgagaaaccccactcttcagggcaacttccttcaatatcctttgcttcatcttatttttttctaaggataaatctgttgaccattttttcctttttctgattctcttctcgaactttgctcactttcatttcaaagatttcctgtttgcttatacatcccaaatcttatctgtactcctgatctcccagcccagggcttactcagacactcagttatcctacaaaacatcttacgcgtatctaaataaactaaacagaatcctttgaaattgacccacaacaacccacgcctaacttctcaaaccctaccttagatctatgcctaaacatacagcatgaaaacttgtaagtaatttttgacttatctttattttacataattaccagcatgtctttacttttcatttaaaataacctcatttacatccttatttattcatctgtcaaatcaaagctattaagtttttagaaacagtgaggaaagaagaggtagaagagaggtctcttcctaacctcccctccattcctcctggccgtgtgtccctgttcccatcagggggccttccctctcttccatccacctgtcatgaaggtcctcagtccctgcttgcctccacctaccaggatctcagccttcgccctttctcctccatgaaactcttgctgacaaatgtagctctcaggaacctgccactaatgcgagtgcctttatactggaccggctacggataactgtgctgcttttctcagaaaccctccgcagctagggaagctaaccccgactctaccaaaaatacaaaacttagccgggcatggaggcacatgcctgtagtcccaggactgtgttgtgttttcaaagtgtagttgtttcttgccttttcatataattatgacatatttttgaaaaagtaatttccaggttttattacatgacatgacaaattggagaaaatgagtttcaaaagtatgtatgtgttcttccattttctaatcagatccttctcatttttttccccaactggaagatgctaggtgagactgtctacactaagtgacttataaaaacccaaatggcttcaaggcaaaaggcaacctcatcatctgttttccacatccagcttcaagttttccttcctctgggtaacaataatctcctactttggactcattcctttcctgctgctcacccatcaggtaagacacctataatcactcatcagaacctgctaattggaattaaaattttacttgtttcatgacttaaaattgatgcttgtttgatgtcgctctggagtgttttttgtttttttgcgggggacgaagtctcactctgttgcccaggctgaagcacactagcacgatctcggctcaccgcaacctccacttcccagatccaagcaattctcccgctcagcctctcaagtagctgggaatacagacgtgcaccgccacacccagcaaatttttgtatttttagtagagacggggtttcaccatgttggctgggctggtctcaaactcctgacctcaggtgacctgcccacctcagcctccaaagtgctgggattacaggcatgagccaccacacccagccctctctgagtgtcttatgatcacactggtagcaggttaatagatacatgtaagtgagcacagcatgtagagtgacacaacccgacatgagcacacacgcaggtggcagaaataagaaagcacggaccatgcccaaggcaggcggcaatgaggaaggcacaacagcaggggggcatcaccagctggtgcgggttaccagggtgaggcggggtcagccctcatgggaacagggcctgagaatttggaaagagggaagagaatgtattgatgaagaatgtggactttgatcaggtggaaggaatgacatccatcaggactgagaggcaggaaagggtgacgggatgacaaatatttgcctagttgatgggaagagcatgacctaaggtgtgctgataggagaggacttgggtgtggaatgggagtggaaaaggatcaggtgttgagggcctctgctaaaaattccttgtacttatggctcttcaaagccatatttgtaaagaggaagcatttaggaggggcacaagtgcagtttggagagatggacgttttacacatttgactttggctggagaaagtagtccacagaagatagccaagagattgactcggcttctgcctgtgtgtgcacagacagagcccacactaactcatcccggtgccttcctcactgagagcaggcaactggacaagattttttcctgagggtcatcttggttcattcactcatgattggagatgtcatcccactgctgccaggcatggtggctcaagcctgcaatcccagcacttggagaaaccaaggggagaggactgtttgagcccaggagtttgatgatgcagtgagctatgatcacgctaatgcactccagactgggcaagggagcaagaaatgccccctttcttaaaaaaaaaaaaaaaaaaaaaaaaggctgggcacagtggctcatgcctgtaattccagcactttgggaggcagaggtggggggatcacctgaggccaggaattcgagacccacctggccaacatggtgaaaccctgtctctactaaaaacgaaaaaaaaaaaaaaaaaaaaagccagacatggtggtgtgtgcctgtagtcccggctactcgtgaggctgaggcagaattgcctgaacctgggaggcggaagctgcagtgagccgaaatcacaccactgtactccaggctgggtgacagagtgagacttgatctcaaaaaaaaaataaaataaaataaaaaaataataataatataaaggtacatcctaacccagaccattttcttaaggcaccaaatgaggcacacaaacctagaagagtgaactcaacactgtgtttgaagaccaccccacagagcactaaattagtgccagaaaccacatacagcacctcaaaactatgacacagatactgttcccattttacagaagatacagtggaggctcagagacagtaagaaattaattccaggatgcctggctgtcaggcatccaggctgtgactcatacccagctcctggaggttcagaaaggtgtgctcatgtcaacacctccatgacatcaagctactttactggacacatttgcaagttctattaaatgtctactaataaaaattagccaataaatttccaggcagggctgacacaaatgacgatggccaaagcagccgctgacagcccaggcctcttctgataggctactgcctgctgtactggatggtaaatactttggctatcactcctgcttagaagggtttcaggaactctctcttggctaatcataattaaagtaaaacatttaaaataactccacctcaggattaaattacacaagttacaggaggccataacttgtaacaagtaaataaatgaatgaatgaatgaatgaatgaatgaggacatgcagcctaataaaaggcagaattaattaggaaagtccaggggctccagttctacctcatcccagaccttaacatgctgtgtgacccagggcaaagccgaatcactcattgccaggaagtattgtaggggattatccttgaagccattgaaaacacctgataaattgcctcgggaaaccattttgctatagcagctatgcatgctttgctacagcaagtgatgattattttacatttgctaaaaagaaaaaagttaggaagacagaccaggccatttcctttacccatggatctcaagaatacaccagggaggagtgaacctggcccagcctcacgtagcatccagaaggtacagatccctggacagcaacaggtagaatctctaggacgactgctctcaaacactgcatggccaatgaatgccacagagtgttttcgcttggaaatgcacatgtgtacagtttgcatatgatttcaggggattcctaaaccaggaaccacaggacagcagagctctcattaagaacctctgattctaagagagtaagaaatcaccaatctcttgacctcttctgggaatgtaccactttaatccctaagacatagtttttactgctccagtatcctgtcactgtcgtttgcggctaaatgctcatggaatatctccaaaagaatgactattggaggggtaaaaacaagggcctagacataccaagcggtctacaagaatgtgttcccacagagatggtggcagcaacgcatatttatacagcattcacctagacaaggaatttccacttccacaaaggcaactatcaaattcaatcactgagattaccttgaatggaaattaccagtcagtgtgcaaaatcggctctatctctaatccacatacaagtatatgtaatactcaaaaataggacagcaaaacattcagtgtgagaacgtgactgaacttgaagacaatgggccctcccactacccaccctatgtaaagcaaccaaaggtgtgctggaaacagatcaaccaacacccaaatgtgatcgtcagttccatccccggcgcatcattttaatatctgggaaccgccaacaggtgttacaccaaactgtgtgctaggttgtgttcaataaaaatgcatgaactttttttggaatatatatatatatatatatatatatatatatattccaaaatatatatatatttaagtacaccaaatatatatatttatatatatttaagtacaccatatatatttatatatatttaagtacaccaaatatatatatttatatatatttaagtacaccaaatatatatatatatttaagtacaccattaaaaagctaggggggaaatttaaccattgaatttcttctttaaaaattcagataaaattttaagaactagaaatattactatgattcttataattctacctaagctgtcagttataaacagtttaagatacacattacctcttagtcaaaccatcatcttcatcttagggggaatgttcacctatccaaacgccccacaaccctctgcagtcccattcctgctcctcttcacaccatggcgttcaccagtcatttctaaacgcagcagccagcttttccctcatcctcattgctcttgacttttcctgcagcatctgatgctgttcatcatcgtcttttcgagatatttatgtatgctggcttcagggatataaatttattttattttattttttgagacagagtctctctctgttgcccaggctggagtgcagtagcccgatcttggctcactgcaacctccgcctcctgggttcaagcgattctcctgcctcagcctctcaagtagctggcaggtgtgtgccaccatgcccagctaatttttgtatttttagagacgaggtttctccatgttggccaggctggtctcgaactcctggcctcaagtgatccacccgctttggcctcccaaagtgctgggattacaggtgtgagccaccgtgcctggcctgattttctttcttttaatatctgcctctttccactcctgctaccctgcccatctgctaagcacaggtggtctccccttgcatctagaggctccacctctcagaactctatcccctcagtggtgatctcatgcccttgtggtgccattctctaaggatagtgactcccaaaccagactgtgcaatcattgactttcttctgccttactcctactgtgccatgcatcctgctggctgacctcttctccatgtatgggaatgcgtaacatgtttcaattgtgaactgaaggaaacctcaataactgtcactgaacatgtttaacacagtccaataaataacttcaaaggatttcaacatgcaaaaaaaaagctttacaaatttatgctatgagttgccaaaacattttttatattctaagaaaaaggtaaaatccagattctgtctgaatttttgatcctcagggatcttctgtgagctttgggcagccacagaagttggccttggtagtagcagggagtcctgagggctgagctgacctctccagccccatgcctgttcctacatcaaataacttaatcagaatacacactgttcttagatttctgtggaggtaattaaataacaattcgatgccaattaatcacagtcaaataagagtctgtcagagaagaactctatacacattggagtctatttaatggtcaaatacttggcaggatcctagttaaacaatgattcattaaacctcctgtgccacacaatggctaggctaaactcaatgtgaaagaatcgaaactcttttgttctcccataaaaagacatcaaatctctgtgcatgatattcttttctccattacttagcagcctgctcaattacatgattctgaatgtgttcagctgctcctatgcacagggcgtctgcaagtccttgttggctctgaacatcatagctgtgcaactctttccttcccaactgaaaaagtaaagagctggacagctgaccacacctacttacaatatttattcactctgagcagggaaaaatcacagactcagaacctacctttcaccccgaaggagaggcaagctgtggccatttccctagacgcagacgattaaccaccctaaaaacccaccatccgtacaagttgtcaatccagcaaaaatctgttcaacatttttggttccctgaacctaccttatcaacttggttcctttaaattaaaaagtccctttttaacacaactccccatgaaaacctagagatccattttaagtttggctgataattcccaaagacttttaatcatggttctcagaaggactccattacctccctggaagttcatttcttcctatggtgaaagaatcaaggaaaacggcctagctctgtattgctgtgcgtttttgcctacactagcaatataagcacctccaaagtttcactaatgctgtcattttttaaaagcatgattttggcacttcattgtagatttgaatctgaatgagagatcacgaagttggctgaaaatgggttctttggggttagcttgcagatgctgttgacgattgcatttacctctctttaaaggactcctagccagtttgttaaatgcattcaaaagtaaatttaaaaaaacaaatattgcgtaattattaaaatattattttacatgttcattgaaattgaataacccagatgggtgcttatttttacctggcacaagtttactggataattgccaatcatattaaagcataaaggtagctaaagcaataaacataatgatatttctgatgtgttcatttgtacaggaagttatccatttgttggtctttgtgtattattttttcagatggactgcaaatataatggacatgttgtggatattccaaattctcttgtggcatagtactgattcaggactaaggttgtaggctatttgatgatattcaatttgccaatattatatcctgctatcctatgaaaaataagtaaaacaaaaatgtataatataactaaaatggatagtatttctcttatttaagaaaaaatacgtactagaaaacatttgtagaagaaaaatgtttcatgaaaaaaaatttttaaagatgattcagcttccttcccaaattaaatttattataatagagcaaagctatatattacatgacattgctttcaagaaaaacttaagaatcttaacagaaaacaggccaggcgcagtggctcacacctgtaattccagcactttgcgaggccaaggcgggtggatcacctgaggtcaggagttggagaccagcctggccaacgtggtgaaaccctctctccactaaaaatacaaaacttatttgagtgcagtggcacacgccaataatcccagctacttgggaggctgaggcagaagaatcgcttgaacctggggagtggaggttgcagtgagccgagatcacaccattgcactccagcctgggcaacaagagcaaaactccatcttaaaaaaaaaaaaaaaagaaaagaaagaaacttaacagaaaacttatcgtattgcaaatgtattttgactttgcttataccttgaacaataggaaataaagatcgacttttattgggtcttcttggataataaatattaaattcacatgcagacaatatcagtgaatgtagggtttactgtatatttactatttttaagagatatacaaactatgaaccaaaaactggaaagccttaatacagaagcaaaaacagaaagcattaaataagtggctttaattgtgaatattaaatctcttttttgatccctgtcataaaacccacattttgttttctgctgctctgacagtacacaatgattactgcactgtgtgtatttatttgtcagctacactatgatataaaatgattttgaggggagaaaaagtcacactgagtctgacataaacataccgtggcaaaacaaattttcctgcaaatataagcagttttacagtctatcaaagtggtgccaaaaagtagatttattcgcattaagtgctgacaggaacgaaacatttctgcagtaaataaagtacattgtaacccaatcgtcaaatcaataaagtcattaaaaatagactgcattcttcaaggaaatggtgagtttaagggggaaaaagaaaaatctttggttgcgatggagaatgtatctccaaacacagctgacaattaccaatttgaactgactcttctcccgtgtgcctacaaagaaacatctttgggtcccttatcttttttcatgtgtatttagccatgtaaactgctatatggcatttccggcttccccacaggcatcctagaaatacgaacaagaaaatgcttttttttctccttcttcttctttttctaggctccaaactgacagaatattatcacttttgtagactcttgcaaatctgtgcagtggtgttgggcagaaatgtgctgagattataatatccatttatctaaactgccagcatgtaacaaaactcaggtggggtgcgtgccacctaaattaatttactacttgaaaaagacttcttatgccaagcctgtcaaaaggcaaacaggaaaggagttaagaaactgtaaataaatctaaacacagtttgtgtttgatctaattttcaagtgtaggattaaaaaaaggggaagcatgccaaggaaaggcgacaagaggggacgcacaacaaaaacccgcacaggctccatcacatgggcgccttgttttcagggaagagttgcccagccaggcgcagtggctcacgcctgtaatcctaacacttttggaggctgaggtgggcagatcacctgacgtcaggaatttgagagcagcctggccaacatggtgaaaccccgtctctactaaaaatataaaaaattagctgggcttggtggtgcacgactataatcccagctattcgggaggctgaggcagaagaattgcctgaaccccagaggcggaggctacagtgagccgagatcgcaccactgcactcctgcctgggcaacagagcaagactgtctcaaaaaaaaagaagagaaaagaaaaagagttgcccaaagatgtcaggcgacctggcactccccacaattaacaactcaaagctgccttgtaggattcattgatttaagaaaataaaggaagtcactaccttacacccaggagcatggctactatcataaaaccagaaaataccaagtgttggcagggatgtgaaggaattagaattcttgtatatagttgggggatcataaaaatggtccaggtgcaatgaaaaaaaaaatatgacaggtccccaaattatgaaacacacaattaccgcatgatccagcaattccacctctacatatatacacaacagaagagactacgggggtctaaaagagatatgcgcacactcatgttcacagcagcactatgcacaatagtcaaagggcagaagcaacccaagacatcaataacaaatgaatggataaacgaaagatggtacagttggttgtccctctctatctgtgtgggattggttccaggacctcccaccaataccaatatctgcaaatgctcaagtccatttgcatataacatacagacatcctccaatataattttattttttatttgtttactttttgagacagagtctcactgtgtcgccaagactggagtgtagtggcgtgatctcggctcactgcaacttccgcctcctgggttcaagtgattctcctgcctcagcctctcgagtagctggaattataggcatgcactgccaagcccggctaatttttgtatttttagtagagacagggtttcaccatgttggtcaggctggtctcgaactcctggcctcaagttgatccacccacctcagcctcccgaaatgctgggattacaagtgtaagccaccgcgcctggccctcccatttaattttaaatcatccctagattacttataatgcctaaatacaatgtaagtgctatgtatttgtaatacattatttttttgttgtggtattataattttttattggattgtttttccaaatattttccattctcagttggttgaatctgagcacccacagatacagaggctggctgactgtatatacacaccatgcaatattattcagctttaagatggaaggagattctgggccattctacaacatagatgaaccataaggacattacacgaaataaaataagcctctcagaaaaggaaaaagactgtttgattccagttatgtccagcatgtagaacagtcaaactcagagacagaaagtagaagggtgaatgccagggggtggagagaaggggtggtggggagttagtgtttaatgggtcctgggtttcagtttgggaagatggataagttcaggagatggaggatggtgacagctgcacaataatgcaaatgtacttaacgtcaccaaactatatagagtacttaaaatgattaacatggcaaatcttacgttaggtgcattttactatgattttaaaacttttttttttttttttttttttggagacagaatcttgctctgtcacccaggctggagtgcaggggcacagtctcggctcactgcaacctccgcctcctgggttcaagcaattctcccacctcggcctcccgagtagctgggattacaggcgtgcaccaccacacctggctaatttttgtattttcagtatagatggggtttcaccatgttggccaggctggtctcaaactcctggcctcaattgatctgcctgccctgacctcccaaaaaggtgggattacaggtatgagccaccacacccagtccctaaaaacatttttttaaaaaaactttccagccatccttctctcagcatccagtctatccatcacatgcatccattcctggagacaccatcagagcattcagctcgacgtggacactcagcacccaatttgcctgggtcacagaggaggtacctgctgtggtagcccctctgtcaccaactggtgagagagatgagacagtaacagcacttctggagaccagagtcccctcccacctccaacaaaggagaactctccttgtaggataaggagagcaaagcgaagaacaacaacagcgacatctgaggggaggaatggcaaaggaagagcctgcctgtggtggcagagaagggtgctgaagggacacaagagccaccttatgcagagaagaaaaggagaatgaagaggatgtgggtaagcattttactctgcaaagcattgggtgacccttagaaaacgccatagcaattgacctttctgaaaaatattttacacaatcaatattcttgatccccactttcctgcccaagccaaacacgttcaggttaagatgtaaatgatgaatatgaatgaaatgccaccccactgggtgacatggctaagtcaacacaatgatattcactaaagccttccatgcgctacaatttcaagaggagcccatcagaagctgattgttcctaggtcagttaccaatgctcagatgcatgaataatggtcattcagaggcagtaaccatcctagccctctgtgagcttgtatacactgagaaccgaaggccaaaaggaggagggggaaatgccaaaaaatatatatgttattttttaaaaagagaggatagaggatctaaatggaagaagacagtgacgtacaaacattctctatacttccaggggatgtgtttctagcaatgaaaagtaaagataaatacataacgggatcaagggaagtggagaagggcgagtcttgagtttaaagaaggaaaatgctgcagactattctagaaaagtgttctaagaatatgtagtgaaggaaatgtgatcccaggagccatttaaatgaaaacaagagaggccgaggtaggcagatcagttgagctcaggagttcgagatcagcctggacaacagggcaaaactctatctctacaaaaatacaaaagctagccggaggaggtggcacacacctgtaatcccagctacttgggaggctgaggcaggagaatcacttgaacccaagaggcggaggttgcagtgagccaagatcacaccactgcactccagcctgggtgacagagcaagactctgtctcaaaaaaatttaaataaataaataaataaggacaagagccatagagaaggaaatgatgctcaggggaagtgggggtcctgggaggtgggaagaggagtgcaagagggcagtaccaaatgcccagaggatcaccaagcagcgatgacacccaggagcttggggcctcactttcagggtatctgcaactgatctgattaagtctgaacttggggggaaaaacagaccctaaattactagtctagtgtagagtctcctgtccacagaggttcatgccatggaagacagcaagtgacatctgttttaatttatattttcataaggcagtaaggaaaataattagcttaattattgtctcccttacgcaaaagctatttgaaaatctctggataagccttgatggtgggtaggagagaccaaatcagagactcacaattcattcactatttcatctaccatttagctatctgcaagagacaccagcacgagcttgagaatcccaccattttaaatggtttctagttttgctcatatttaatttagactcgtaaaagtgaataatgatatcaaaatcagaaaaagttacagaggcataaaaattgtaattttgcaaactcaactaaagttttccgtgaaactaaagttttcagtgaacactctacatttcacgatcaggtaaaatataataatgtccataattcttttttttttttttttgagagggtcttgctctgttggccaggctggagtatagctgtgcaatcacagctcactgtagccttgacctctcgggctcaagtgatcctcccacctcagcctcccaagtagctgggactacaagcacataccatcatgcccagctaatttttgtatttttttgtagagacagggtcttgccatgttgaccaagctggtcttgaattcctgagctcaagcgatccacctgtctctgcctccagaagtgctgggattataggcataagccactgcacctggcccataattcctatattaaagatgttgctcacattctaaacacccatattaataagagaaaatattttgacaaatattctcagtttgacttttcacttatgtaatttaaatcattaggcataaaaactacctactgtatgtaattgtaggagatatgtttgtaaatagcaacatgaaactattacttatctcataaactatagaaatattattttaaaaatacaccacagctagtcattaggactgaaagaattccagtttcaatctctagttaaatttcaatctaggttttaaactacatctagcaaaattaaaacacagtttttaaaaatgttagcaaatcatgattttttggatataatttaatataaaattaagtagaacagtaattaatgttattaatatttaagggacagcaaggctttcattgtggggaaagatctcaaatttatttttattttatttatttagtgttttgagacgggggttttcactcccgtctcaaaaagtgagtatagtggtgcaatctcggctcactgcaacctccgtcttctgggcttagcctcccaagtagctgggactacaggcatgcaccaccacgcctgggtaatttttgtactttttgaagagacagtgtctcactatgttacccaggctggtctcaaactcctgacctcaagtgatccacccaccttggcctcccaaagtgctaagattacaggcgtgagccaccgtacccggccagatctcaactttgaaaaaagaaagagaagcatctgggtaactttggtttggactgacagtagcctttctgagggtattcccagcatgaactagtagtgacaggagcctaagttatactcttaaagttacggatgaattccacaaaggagatccagtctcaaatggaagccaaaaggttcctctacaaatagcatgctaactcggaaagacaggaaattccacagccacacatcaattctcctagtttgagtggaactcctttctactctctcacctaagggtggtggacacgctggggaaggacggggtggagaatcaaacacctgatgatgcaacaagtccctaggaagtgcctgggaacatgcctgccgaacgcccagcctgcccaggcgcacacggctcgccactgccagcatgtgctgctatctcaaaaaggttcccacattcatcacattcgtgcagaaagcacagcatacttcttgacacccagagttgggccagggatagagtagcaggtttatgcaacattttactttacatggtttgctctgcagagaactctggcaaatcacagatggtaggcataaaggtagatagggccaggttcttttcaaggttgtcacttcacacacctatctgctctgtcccctaccggatccaccccagctcccagccagaagagaagatctgcaacaagcagtggaagtaggaaaatgtctattggccgctttcataacactttccaatgatggactaagccagatcactggtctttaaaacactcaagtaagagctctcaccaggaaggccacgtgtattgagactttcttactcagagcacaacatctatgctttgtcctgctccagctcacaggcctcagctgctacaggcacttccctttcagagatattagtcacagtggcattaatttgtcactacaaaaaagtcttgctgtttcccatttagatggtagatactgcatattttgaaaataatatagaaaatgaaacccatatttttaatggacagtctaaaattctacatggtagaatatttaagggggggtaaaatcgttaactcccatattttaaaggaagaaataatgaaaacaaaaataaaatgtggaaatacaggaaatgggagaggcacctgcgggtcaaatgcagccccacaggaagctttcctggtggtgtccctcattcgaaagatgggggggaactccaatttgcacgggttcttcaggccccatccagaacactccttaaagcacgatgtggacaggaagagtgcttatttggttgttttaatataaatcattttagagactggcccaaatgttgcaaagggttcacaagacacaggtctttgatctctgtggctttgccatgtatgtttttaacattgctggaatgcacccagggaggcaaactgtttgacagagaacactataaatatctgaataaataaatacatacagacatctggaaccctgattaagcagcaaagttttattttctttggggaaagtgggcggtggggcggggggaaccaatactgaacagcatttttatttttacagaaaaaggaccaattctttccctaagataaagcccttagagtactaatgaaacttttagaagctcaagtctccaagtctgttgctgcctttccacacacaagcacgttacactttaccaattaaaactttactgcaattccactttttaaatgaccagtggtaaatgaatatttatgaaatattggtcattatttataagaaaataaacccaggaaatatactaatttgccctggagttccaaactaaatgtgtacatgtccttatgcaataattttctggattacagagataataaaatatgttggtttactcctctttgggaggtgcttggaacaggaacaaacagtaagaagatagactttgctgctattatactcaatgcaattaaatgaaaatcaaagaatcaaaatggccacaaacaatatggtgaaatgtgaactaagtgtcagatagttacaaaatttgtgacacattaaaataagttcatgtttaaaacaaacaaacaggccaggcacgatggctcatgcctggaatctcagcactttatgaggcccaggcagtaggatcacctgaggccaggagttcaagaccagcctgggaaaaatcgtgagatcctgattctaaaaaaaaaagtttaaaaatccaaatgagtccctatttttactcttaataggttccctgatgaaatggagctccggcaagcaccgaaaggtgacgttatcaggcatccattttactgaagacaaagccttcctgctctagggataaagtttaaaatcctttatctgccctgcatggcccaacctggcctgggcaggccctcacaccacctggcctgcaatcactccacgccagctgggcagctcctttcccttacctccagggctgctgtaaccccaaccacccatccccatgacaggtccgtgagagatccttcaaggctcgccccacctcaaatctggttggcttgtctcctgtactcccgtggcccctgggcctctccttccacggagccaatcccaagcccagccctctgctgcttactgcgcatccatcttccccacaattttgacgacctcttggcctagctccaaacacagtgcctaactcaagataagactcagtgggtatttctgagtggatgggtagaaattaagtgaaagtttagaaactggcattttctgtatttgctctgtttacaaaagagacatgatgggaacatcattatgagaactgagaccagtgttgtggctgggcaggattggccgcccaaaggagggatgaaggaggtcaccaaacgttgatgtcaatcaaaggtgggaaaataaataaatacccagtggtcaaattcaaaacaagaagaatgtgccagcttgttcctgtggcagctgtaacccagaaacttgaccctgttacagagaagcatgagggcaagctgtgtagggggtgagcaaaacacccacagccccaggagcccctccagccttggcacctacacagcccatgcccaatggggccgtgagtgctcagaaatagcacgcatatgtatatggtgctacttggcctctacctccaggaaggcaggatctacggacattgtttaaatgcagtttaaatcataagatgagaattcatcttgttctttgttctatgttccttctttgcagcttcaagatatttaaccatcccagagtcatattcaatggttctttcccatgcaattcatacctgtatatctccccaaattgacagctgtcctgggggaaaaaatttaaaaaagcaacaacaaactccagtgctaaaagtctgggtggttagtcaaacctgtaccaatatgtgcttccataattgccagaacatcccttggcacgaagctggcaaccatgcagatggaaggcttcccactgattccatgctgacctcctgatctctagttctggttctgatctggtctaggatccactgccaaagtcagattctgtgtgttgccttgaccatctccaggcctcatctctccttactcttggacagatccacttactcagtcttaccttcagttctgcttcttccaaaagtctcctcactcatgatgtcaaccactgaaaacctgaagtttcagcgctagcccagggcactcccaccacccaccataactggtacacctacggggctctacgtttcctcaactctggggactatccccagtctctgtattccttagagagaagagcacttcatggactcggcatagcatctaaaggaaaggcaacaaagacagccaaacaggctacagattgcccaaggaatttgcaagtgcattaaaacctaaagttttctccagacacaaataaaatggacagcaaaccatcctattaattcaagccaccaaaaactgtaccagggtagtggccctaagaatcaatatggatatctttacagatagttaaaaagatatcaacagaataattgccttttatgcattctcttagcacaaaaatctgggaactaagaagagaggagaaatttctgtataaggagaaaagagtttcaaatctataaggaaatcatttagttgaactttaaaggaaaaaaaaagaaaacatcagaaattctttacttgcaggatctgcaatagtgtctgtcaatcattcttgggaaaacccagctgacacgtttgcagttatattcttggcctagtatctatcgatttctatggctaattttttcatactagttcttcccctttttcctccaaatccatattctgcccgacattttccatcactcacaggttatgtctgctattgtaacctacaggaacaaatattcatctcctaagagctatattgcacaagcttttcatgcctattatgggaaaatcaggcttctgcacgacatcaaagtccttgcagaccatgaccttaactgtgttctcaccagcattcaaaacctggttgcattaaataatactggtggaggctcataatgaaataaaaccactacaggatcccaatctctcgggcagtcatagactctgcatccctcagatgaaaagtcgtgttgctcatcactgaaaggtttccttacagctgaacagatctactagttacaaatctgaaattgcaaatattttcaccagaaaggagtaaaagagctttaatcctctgacattacaagtcggaggcaaaggcaacagccagcacaggctgaaggggtcaagatatcaaatgtcatgagatgtaatcaaaacgttaaatgttcttagactgtttaggtcgatttacttttcactgagtttcactttgtttctctttttgtctagatgcattatttatcatccgggtgtttttgcccaaaatttgtcctcaaactcagcaaagaaaacgaaaagcttcaaaagtcaaagaatttaagaatcctctgaggtgcagtataaaagcagagaacaaagaatgtaccataaatataaagctccacatgtaatctctctgactaagttgcagcttacacaaggtggggggtggggggtatcaatgaagtttttaataaaccttaacatatcttagcccatttttgaaaagaaccttagaagtgagactgaggggaaatggtaaaaataccatagttattctactttgggccaaaaaaagagaagctaatccaatcatccaaggagccagttgctccctcaacagaaaatggctgtgttattcagtaaacctatttgtgtgtattgactctttcgtaagagacggggtcttacgatgctgaccaggctggcctcaaactcctgggctcaagggatcatcctgaaccagtctcctgagtggctgggactacaggtgtgcaccacagtgtccagctctatctttttcagaggaccatcaatacataaaggaaactggaaactggttttccctgaagcaacagaaatagtgatatctctgctggtgggaatgtaaactagtacaaccactaaggaagacagtgtggagattccttacataactaaaagtagaactaccatttgatccagcaatcccactactgggtatctactcagaggaagtcattacgcgaaaaagatacttgcatgtgcctgtttatagcagcacaatttgcaattgcaaaaatgtggaaccaacccaaatgcccatcaacaagtggataaagaaaccgtggaatatagatacgacagaatactactcagccataaaaaagaatgaattaatggcatttgcagtgacctggatgagactggagactattattataagtgaagtaactcaagaatggaaaaccaaacatcgtatgttctcaactcataagtaggagctaagctatggggatgcaaaggcataagaatgacacaatggactttaaggacttgaggggaaaggttggaaagggggtgaaggataaaagactacaaatatggtgcagtgtatcctgcttgggtgaagggtgcaccaaaatctcacaaatcaccactaaagaacttactcatgtaaccaaataccacctgctccccaatagcctatggaaataaaaaaaaaaatttttaaatttaacaaaagatcatgagtaaaccagaaaaaaaagaaatagtgatatctaaggtacacacttaagttttagaacaaagaacaaatagatggctagaattaggattagatcttatcatcatactacttgtgaaaagggtatgagtaaaaatcagtgtctcactataaaatatcaagccttgtgaagactaaattagaagatttatgaaacgctattttccgcaaatttccaaatactgtttgacttctacagcaaacaagaaagaaagcaaatctcttaaattactgccaaaaaaatataataataagaagaagaaacaaggaataaaatggatgatagaagaatctctgtctttctcatcaccatgatttatgggtggaggagggcaagtagctaaaaagtgggccatgtactaaaaagcctagctatataaataaaacaaggcaaagaaatttttcagctggggtctcacctggattggtacatgtgtgactctaggctcacaagctctgagcccaagccaggtttgatactgaaccatcaacattactaatatggtttcttctgagtagaccaccaagagaattcaccaatctttcgatttcccacattttttcaggcctagagaacagctggatgggatttccacaagcttgaaaggcacttggctgtggttcttctaacaggaacctcctgagatgccccttctgaccatgttattctgtcattcaaagtctaacaatgatgagtcctattaaaagttcaactgcatttccaaaatagcctacatgaaatgttctagatacatttataattaaatctaaaatttatgagaatgaccaaagacatcttgaaatagttaacaggacttctaatttggaaggatttgagagtttattctctgtctcctttccctctttctctcctttttattaaaatataaataaaaagttctccattatcactttggagagctaaaaaaggaaaaaatgttcataccaaagacagaattatttccactcccagtaggacacaaatgccaaggaatagctatggtagcaccattccacagtatctcctatgacaccaaacactacaaatttcagagctagcactctcctaacatatgaccggttaaaaaattataaaaacttgatttagaaagtcatgccaatgtactgctagaagtctagaaaacgtatgcccatgataacaggcaaaagtgatcatctagtttgcagaagcagtaacatttactacatagtaaaaacttttttctcccattgtgggactaactcattttcaaatgctaaatccttctgaaaattgataaaagcaagtttatgtaacagctgagtaaacatttcagaaggtgaagaagacagaggttaaaatatttcttagtttcacacatgtaactcaaattggaattcttatatcaacattacacacacacatacacattcagacagataaacgcatccattagatacacactgtgacacctgttatttgtgatggatttttccaggtcacacaaatttgtcaaatttttaaacatatgattaataagatatccacattcattggaaaggaagtactatattaaacgtaacttaacccttatctgagggggtgaagcatgatgataacataaaatattatactatataggaatgggcgacataactttagaaaatgcccagggacaaaggctggaagcattctccttgataaccagtaagacaaggaggcctactctcactacacctattcaatactggaagtcctagccagaacaatcaagcaagaaaaagaaagaaaaggcaaccaaataggaaaaagcaagtcaaactacctctcttcgtagacgacatgattctatacctggaaaaccccatattctctgcccaacagctcccagatctgataaacaacttcagcaaagttacgggatacaaaaatcaatgcataaaatcagtagcatttctatacaccactaacatccaagctgagagccaaatcaagaataccacggccacaaaaacataaaatatttaggaacacaggtaaccaaagacgtaaaagatctctacatcaagaattagaaaacatggctgaaaaaaaatcagagactacacaaacaaatggaaatatattccatgctcatggataggaatattgtcaaaatggccatactgcccagagcaatttacagattcaatgctcttcctatcaacctaccaaagccatttttcacagaactagaaaaactatactgaaattcatatggaatcaaaaaatagcgtccaaagagccaaagcaatcctaagcaaaaagaacagaatctataaggaacttaagtttacaagcaaaaaacaaacaactccagtaaaaaaaatgggcaaaggacaaaaacagtcaccaagcatatgaaaaaaagctcaacatcactaaacatcagagaaatgcaaatcaaaaccacaatgagatatcatctcacaccagtcagaagagctattattaaaaagtcaaaaaataacagatgctggtgaggttgcagagaaaaggaacacatatatactgttggaggaaatggaaattcagccattgtgggaagcagtctggagacttctcaaagaacttaaaagaaaactaccatccaacctagcaatccactactgggtatagacccaaaggaaaataaatcattctaccacaaagacacacatggctggacacggtgacttatgcctgtaatcacaacactttgggaggctgaggcaggcagatcacttgagcccaggagttcaaaaccagcctgtctgggtaacatggtaaaaccccatctctacctaaaaaaaaaaaaaagaaaaaaaaattaggtaccacatgcctgtagtcccagatacttggaaagctaaaatgggagaatcacttgactccgggaggtggaggttacagtgagctgagatcttgccactgcactggacaacagaggagaccccatctccaaaaaaaaaaaaaaaaagagacacatgcacttgtatgtttatcatagcactattcacaatagcaaacacaaggagtcaacttaggtgcccatcaatggtggcctggataaagaaaatgtggtacatatacaccatggaatactacgcagccatagaaaagaacaaacttatgccctttgcagcaacatggatggagctggaagccattatcccaagcaaattaacaagaaacagaaaaccaaatatcacatgttttcacttacaaacaggagctaaacatttagtacatgtggactctgagaaggaaacaacaggccgggcacagtggctcacggctgtaatcccagcactttgggaggccaaggcaggaggatcacctgaggtcaggagttcaagaccagcttagccaatatggtgaaaccccacatctactaaaaatacaaaaccagctgggcatggtgatatgcgcttgtaattccaactactcaggagactgaggcaggataattgcttacaccccagaggcggaagttgcagtgagccaagattgcgccactgcactccagcctgagtgacagagcaagactctctcaaaaaaaaaaaaaaaaagaagggaacaacaacagattctgggacctactttatggtaggaggagggcaaggatcaaaaaattacctatcaggtactttgctcattacctgggtgacaaaataatctgtataccaaaccctccaccacatgtaatctactcatgtaacaaacctgcatatgtaccgtctgaaccaaaaataaaagttggaagaaacaaacacaggaaaatacccagacagaattcacaagacagtaaccggttaccttatgcaaaattcccagcacactcctggcctaccaagatgcttaataaatgctgttataatctgcagtctgattaatgatttatggcaatcatttaattttcaattacaggcatcacatccctgcggttgccacataaaaaccgatagggacaataacaagagtattgggcaagaaggcaaagaagagggtggatctactgtgtggatgctcagaggcagagagactgcaacagatttcttgttgctttgttgctactgcagatgaaacaagacaacggaagtgacagaagttttataagcttaagttgtcaaataaatttataatgttgctataaaattataagacacagggcaagattccaaatgtattgtacctctggctgatcctcaatttggtagagaactagaatgcaactgccagaaaccaaaacctctgtcctacaacagacctctaaaacattcaagggtggggcaaaactattataaaaatcctctgatgtcttacaaacaacctatttttgactttcttaagctcttatcaaattatttctaaaagagttgcacagaatgagagaatcatcgcagttcagagctgagggcctttctgacattactgaggttgaatcctaagactctggactagttgggtgtctctgcctgaagacacaactatctggcaagcaggtggaaaattagtaggtgtcctatcttcatttaggtctctccaccccaaattctattttttatatatcacaatgctagtattatatccagtcagtactttacggcattttaattgttagtttattaatggtaatagtgcagtaacaggagttatctatgtttggcttataattcctttaaatgtcttaaaaacataatttatagtttacaagaactaaccagaaatctcattttcttcccaggttgctttaaacatattttgcgcaagaggaagttttaaaatatcagaatgtccatctgatagaaatgtagaaagattgcccagaattaactggagtgatcaaaccacagactgtctctaaaaacatcccatgaataaaatttgaaggctcaacaatctaaaactgccttaggtcaactttaactttcacttgtgaaatttgtcatttttcatgctttttgaaaaaggtgaatacatagaatttatacatttggactagttatagcattttttaaaaataatgtaagtttctcctactcctaagaagtatatccacttctctggaataattccaatattccatttaaatagaacttattttacaaaatttcaaactctctttccttaattacacaatagacttctgtactcaacttcagctgtatcgttttcaaacaaaaagtaaaccagatgtttggtacttacatgcaaaattgagctctcattgtaaaaccaaattaaatttaaaattaactctggaatgaagctaagccccattgaaaacacaaccaaaaagaaaacatgcaaacaaacaaaaaaaatactctattgattttcttttgtggcttgttagtcttggtcatttatctatttttctttgcatccaggaaaacacagacacccttcccagactcctattgtttcatcaaaactagcaaatttggaatttgtacattttttaagactactaaaatttcatcatctcaattagtcaaaaaaatcaatttttagctgttaggtaccatatcaaatgcttttcatatattgattctcttaattgtcactcacacaaaaaaaggattgtactgttaatatcatcgccatactacaaataagttgaagcagaaagagtttaagtaattcagcaaggaagagctgagattcacatttgggcaggctgattctaaagtcatgctttttaccaaaagggtaccatggatcccaaatcatatagtgatttaaatcccctattagaaaataaagaaaaatccttccatttgctggtgggtgaagtcaaaggacatcttatttgctgattaattttcaaattttaaatttcacatattattaagagaatccaaaaatataattcttattgtggtgggacaagctaactaaaaagtctctctctccctctcccctacccatcacaacacacacacacacacacacacacacacacacacacacacacacacaatcaatgcttcttaagataactgttttgatcaagaggctcttaaatgacaaccaaagttctctctcatttgacatcaaatgaaagtggacatgagaattaaagggagagaaaagatgagctgtattagaaaaaaaataccccatgtttatccaaaaatgatgaggtacttattttgccatataaaatttcaaaccctaatctcatctagaacatttagctactttggtacagcaataactaatggaagaagacatacctgaaggctaggtcaattgagctttaaactcctacagcttctcgtgtgtgaaaggagatgagagtggttagaacatttggcatcaagggaaattaaagcttcttctgttcagtttttaaaattctctaacgtatgagctaaatctattcatctggtctaaagacttgacaattccttaacaaacagcagcttatctgattgtacgataaaactgctgatggctggattacacaggtgttcccttttattaccccggctatttatgtcaacaactatttatttaatcttaaagtgaaagaagaacacttttctagtgacactgatcactcatgatcctgaaatgtatgtgttgattttcctttcatttacaggaccacgtcaagactaacttttccaacttggcaccaataagaaatacttctgtctacaatacagttcattggtagaacttattaaactatacttgactcccttttcattttcatgctaagtaatagggagtatatagagaagatttatattcgcatgggataattgtaagatgtcactaccattttattctccaaaaagagaagaagaatacatttatagttcccccaaaggaaataaattttatgcgcccaggccattctgacaccaacaggaggaaaaaaaaattaaaaataatgactacttttaaaaaagcaaccatttccttccttctctacttttaaatatgtaaaggtaatgaaaaaaaataatccatgattgtaactatgcctcaaagcactgctgctgatcaaggcgtgtggaattgtatgtggagaaaatatatttaagggtaaatctgcttcaactatattccctgttccaatatcattgtgcggaacacagaaagaactgggtatgctattttttcctccaactcccaaaatctctgaactcttctattatgtgcttcaatcagagtgaggaatgagaccagtcactgaagcaaaagaacatttctataaacttccacctgaagttcagagagaagtctgattagctactatcaggctgaagatcaaccaggggagatatactgttttctcagatgttgctgcacagttttagagacagggtctcattctgattcctaggcttgggggggcaatacagtaatcatagctcactgcagcttctaacatttgggctcaagcaatcctcccacctcagtctcacgaggagccggtactataggcacacaccactgtgcacagctaattttttttagagatggggtcttgctattgtccgagctgctttcaaactcctggcctcaagcgatcctcctgcctgagcctcccaagtagctgggattatatgacatgagccaccatgcctggcgagcatgactgtatttggaacactgtctgcctaaagatttctaaacaccagaacaagtctaagacaggctttccaggtgttcaagaggtgctggaacatttgcctatgtgatataatctattaaaatgcaaatgcaaacaagacatgaaaggaaaatgtttccagaacagagaacttgtttttaataaacttcctctcaaaaatgtcctgtttttttcctccccctccctcccccttccccactgccagggcctcaaaatgtactttgaagcttgtcgagtctttatttgagatatgaaagagcttctatttaaacgaggaagaaatttctcaaacattaatcctggtgaccaagaatgagaacactcagtgaatcatagttgaatttcatgataacattacttacagggaaaatatcattacttatgttctttctcctatcaatacttctaaaagcccaaagcgtgtacaggtacttgtaaagggcaacactggaagtccctcccctttctccaacacactttcctaagctgagctgtagcacttagacctcccccagtggctcagaaaagcatctaggcccagtcaagagtctagctagaaattgttgtgagtccacttgaagcttagagattatgatctgaaataaagaatcatttattttgtttcctgaacacctctgctactcccactggtatgatttcttttgaacacaattggttttgaagtgccaaaagaaccatttttggaaattttataaaatcaaggccaatgaattatgaagaagacatatctgatggagctatgctcatgtgtgttgtatctagaaaagtatctagacttccatttggcagctgcattaattttaatatgcatctttttgatatgagatcatagattctgacacaggatggtttttagaagtaatccattgttggtctagtgtggtggctcacacctgtcccagcactttgggaggctgaaggcagatcacttgaggtcaggagttcaataccagtctggccaacatggtgaaactctgtctctactaaaaatacaaaatcagccaagtgtggtggcatatgcctgtagtcccagctactcggtaggctgaggcaagagaattgcttgagcccagagggcggaggttgcaatgagctgagatcacaccactgcactccagcctaggcaacagaccaagactctgtctcaagaaaaaaaaaaaaaaagaagaagaagaacaaagaggaaagaaggaagaaggaagaagaatgaagaaggaaggaggaggaggaggagaaggagaagaaggaggaggagaaggagaagaaggaggaggagaaggagaaggagaagaaggagaagaaggaggagaaggagaagaaggagaagaaatcatcatcatcatcatccactgtcggcaactatttaagtttgcaagtcccttgaaaacaggtacttttgtttcaatgtttgggaccacaactgacgatgagtagaagaccaagaaatgcttgatgaatgaaaaagccactttttacctgttagaaccctgaggctaagagaagtaatgtgaccgacttagttaccacaaactatgatcctagcagaattggggcatctcaacacctcaactccctgtgcaagaacagattttcaatgtctactgatgattttaaatggattaattcctctctttacttcttaagggcatgaagtttatgaaacaaaactatacagtaccagacgcttaacccacagagtgttaaaagtcaccttcaacacacaactaaacccccaaaaaagttattaggtgtttgacagtttcatttctttgactggtaaacaacaggagaacttggtctagttccatgaatcacagcttccaaagaaccaatgtacggtttttctcttcaggccatcacgtatcagaaacaaagtccaccaaagtaatctattacaaactgtacttttgaaaaagaaaattggaagcaagagttaaatttaatataagtaccagctgtaagacaaaaaacactctaattttatttcaacactgtaaagtcccattgttctttatgggtgttgcttaaagagatgcaaatgcactcttggaactatttcttgttctgtccagccaacaaatatttactaatcagatacagtgtatccaatcctgggctcaggggatttagcaaggaaacaacagataagctccaagaagacaaggggaaaacaaggcaaggaagacaagggggaaacaaggctaacataagacaagggtggtaaatacgtaattacctaaattagaatgtaactatcattttcataaacactatcaaaaacttgataaaagcaaaaatgttttaaacttcatggaaaacaaaatgtcacaacctcagcgttgtaaatattctgattttttttccactgtcttcatggcaatataaataatcatgtttataataaagggggaaggaataaaataatggaataagaaaactccaattataagtgaaaatcagttctcatataaaactcaaattaaactccagttataaatggaaaactctcaaattaaaactccaattataaatgaaaaccagagttctcatatgagaacttcaaagtcaaatctttgaggggaagcagttggccttacagtaaaacagaacagcgtttcaagctagcaaatcccaacaacttccacttagtgtccaaaaactatgctttatacatattaggctctcagtaatatacttatcaatatttattcatgttgaaatcggccactgcaagtggctaatggaatatcattaggttattccagaaacagtgttctattttcccttgaaatggttatccaacagctaagaactaagtcatgaagatactttgattcttttctgacaataaggtcacagagaactataatgttgatctaacagtgggggacagttttaaatgacaatacttgaattactattatcagtcacacatcccataggctaatgccaaattactaagcacacattaacagcagatattgggatatgctacaaagccctgagttccaagttagctagttccaagttagccgaagataaagataaagacaacacatatcaaatcagttaatgggggggcgttaaaaccatagccacggacattagactgaagtggagaacttacatatatcgagagagacagagagagagagatacaggcatatacaaatacatgcaggtatcacattatatacactataggaaaacaatttaacacagttaagtaaaatgtcatcttataatttcctgaaatattacatgattatcactttgaacaaagcacattcttccctagttttttatctttttaacattttattggacaaacacagtgctttctctgttactaagttgtcagtatctccatgtatgatttattatggagaaaaaccatgaatcagaacattctagtagattaaaaattatgccaaaatgatgcaatatttaccagctgtagacaagtgctacagtaatcgcttacatacagattactgacaaaataacaatagcaatcaaatatatgtaactacgtaactatttaaactcctaacaaaggcttttatgatactattagcagtaaaggagcaactcccataaaatatgacttcgtatcacccctgataagagtttaagtacatataaccattgttatgtgaaaaaaacattatttttaatttgtgataacccgacaggatttaattaccacacctacttcaaactcttagctgtttcattcaaagctgaaaaaacaatatttatgtggctattgagaatcattatgattgatgcaatcttttgtgttattccctttatagtcacttgcatttgttattattaacaagaaaaaatgaaaggggaaatgtgtgtttttgttttgcaacaaagcttttctggtgatgactaacttcttcctttgaacacaaaaagcctcttaaactaactaatgtacatataaatgtgttctttacaatacgcatcaggcaagggggtgggagggaaagcccgcaggacttaagccagaattaaaagcaatataggcaagattgagtacatgaaagctgtcaggacggttgttattctcaatttcttacagctcatctgctctcaaggaagaaaaatcatagtttcttttaaccatatccacaacagatctcacttgaaaggaaacatagcgagtgatttggcatcaatgggcatattaccaattttccagcatcactactgaatatttatactggtgacgaatgatgacactgaggaaatattttagcacgaagctttgccttgtaaattgtctgaatggtgctgtgtcaaaacaacacctaccataaatcagaggttttaggaccagtatttcttgtttaaacatgctacctgctcagcagaatcacttgtgtgaacaggcatagattaatgtgtgctgggcagagccatcttaccccctagcttatagagctataatttaacaagcctattattgtagaggtaattttgacagtgctgaaatattatacttgttaaaaatgcacatttagcaccaactccagtggtcatttgaactgaataaacagataaataggtatccctacaattatgtttcttctttattgatgactctttttttctggcaaggaagtgggatatggacatcagattttatagagtatcgcaagacagtctttctgatcatataaaaagctcatcatggaggttgctttcagttctccacaaattatttagcaacttgtagtggattccagagtccctttccaggtttcagaaacagaacaatagttcaaaccactaccaccctcctcccctcaattcctgtaggatgcacatcctaacttcccattcagtcaagctgggaaggaatcattctttttttttttttggagacaggttggagtgcagtgatgcaatcacagctcactgcagtcttgacctcccagactcaagtaatcctcctgactcagcctcccgagctgctgggactacaaccacgcctggctaaaagctgagaatcttaatcactggggcaaccctcgatttttgattagggaacataggagaatatgtctatcttaaaatctagtactagcattcgcattccatacctcagtgaccacaagcatcttccactggattaaaaaaaagaaacatgggaagaagtcaatatgtttcttttttcttttatctagtgttttagctctcatttaccttaatctataaagaaaaaagaatgatatgaatctggtttttttgttacactgttgaaggcatcgatgaacataaatatacatacacacacatactccccacgcacacactggagaaaaaccagttgtgtaaaacacactggctgtaacccaatattaacttttacttccctgagagagtaaacaaacacttctaccaacaccagctcttgggttcttaaagccaaattaacaaattgaaagcaagtaaacatttatctggcacccattagagtcagtgtacttagctaaatgttatgtcaccataattaggcatgagaaaacaggacaacaaaccgctcatcttttctccaaaacaaagagtgaaattgtagagacctgataagaataaaatgtctctgctaactctgttggcgtggaagaaaactaaagaaactaactgtgtaactatctttctctgcaaactcatgcttacaaagaaaacagaaacatcatacaagcaaatcataatgtatgcttcaggaattaaaatgcatccaaccactcaagatgtcagcgtctgcctattccagttactagtcaagaaggtgtaattaggaaatccaaaaaaaccctgtttgaaatgctaggtattccaggacaacatcagaaaaatatcttccacaaagactttcatgtttcaaacataatacgccacaatattactttttaaatttcatattaacacatatcaagatacaaagacccaagctataaaaatagaatttccaagaaagctttaaattaaaaaccaggttttgcaatgaggtgctcttacattatatcactgaaatactgcagatcatgctgccctcttgtgctggatatcaaaagcaaaattaattctgcccatgccaggaaaacaggatttacatttaaaataaaaatcatctcttaatttctgaagacttactcttgacctaggatttgtgttacccatttattatgattggaacagaacggaaacagggctaagacacacacaaaaactgactaggaagaggtagatgcagcgaacagtaccagaaaatatctgcaaatgccctattcaactcaggtcataatcaaaatatgaaggaggtgtccgagggcagctgaaaatgtaaggcttcttaacagacacacgtgatcccatcaccaacctacatcaaaagaggaaagaataaaaactagcaatgggtgagaggaggataaaaagacgagaaaggaaaaccggctcttggcagggcgcggtagctcacgcctgtaatcccagcactttaggaggccaagatgggtggatcacctgaggtcaagagttcgagatcagcttgaccaacatcatgaaaccccatctctactaaaaatacaaaaattagccaggtgtgatggtggacactgtaatcccagctactcgggaggctgaggcaggagaatcacttgaacctgggagccggaggttgctgtgagctgagatcacgccactgcactccagcctgggcgacagagtgagactctaccacacacacacacacacacacacacacacacacacacacacaaacagtcaccatttgtccactggtggtcaccttggatgaatgtgtgtccattcttgctgggggcccagcccgctcccaacagcagacagagcatggttgcccctcagacccagctccacattgctcgtcagtacttggcttcttgggaaaactgctatctcagtaccaataggaggtaaaaccctgtctctactaaaaatacaaaaaaaaaaaaaattagccggatgtggtggcagacacctgtaataccaactactcaggagatagacacatgagaattgcttgaacccaagaggtggacatttgcagtgagctgagatcatgccactgcactcgactgggcaacagagcaggaagaaaggaagaaagaggaaggaaggaaggaaggaaggagaaaagaaaggaaggaagaaaagaaagaaaagagaaagagagagagaactggctcttgtcattctaaggcagcacactggtttggctcacattttatcctgctagcttaagatttatcaggttaacgaaaggccagtagataaaaaggtattgtattatataaacaaagatgaatttcatgcaaccataggtgggttcgaaatggagaggaacttaatatctggcatgttggagaagcgtggccttcctagaaacagaaacttcaggccgggcgcggtggctcacgcctgtaatccccaccactttgggaggtggaagcgggcagatcacgaggtcaggagatcgagaccatcctggccaacacggtgaaacccgtctctactaaaaaagtacaaaaaattagccgggcgtggtggtgggtgcctgtggtcccagctactctggaggctgaggcaagagaatggcatgaacccaggaggcagagcttgcagtgagccaagatcacgccactgcactccagcctgggtgacagagcaagactccgtctcaaaaaaaaaaaaaaaaaagaaacagaaacttcgctgctgagaagaaacacagaccttccaggtttaccttccccttctccctaaatccaaataagtgaacttgggaccacagtggggcagtcagggggacccttccagaaggtctggttctctgagtcaccagcaagggtcgcccattcattaaccacacagatgaggatctgggcagaagcatgatgagggggatggcacactggggtgggagtggacataaaataatggagaagacatttctatgctgcagaccagagtcactgagaatattccagcacaagggcactggagatggggatatgagggacgtctagccagacccccggtgtgaatcacctggagtttctgtgccagtcaccatcccaaggtgagcttactggaaactacatgccagcagaggtcctccccgtttcctaagttttctaaaacctgggagaatatcaggatgctgagctcataggaaactcccccggggctcttctaagagcttgcttttaataactaagtattcagacatgcttcccagtctttctaccccactcaaagaacactctgcaattcagggggcacaacatcatgccagatacttatacatatttaacatgtatgtttaagagtactgaaaaatcgagcatgcctgcctcactatcatagaggggaatttttatttatattataaagccggctgggtccagtggctcatgcctgtaatcccagcacttgaggagactgaggcaggaagatcccttgagcacaggagttcgagaccagcccgggtaacatagtgagatcccatctcttcaaaatagaataaaataaattttaaaaattagctggccatggtgacacaggcctgtggtcccaactacttggaaggctgaggcaggaggatcgcttgagcccaggaggtcaaggctacagtgagctgtgatcacatcactgcactccagtctagtcaacagaatgagaccttatttctaaataaattttatatatatatatatatatatatatatatatatatatataactattgaagtgcatacaatcagtaatgtgaattctgaggcgtaattcacagattttgtgtatccttcaccattgtaaaaagtgcaaaaattttatctaaatgaaaattttaattctaccattaaaaaacttttaatttttacattttttcaacatctaccactaaaaaaagtaaataattcatgacctctaaacattttggacaaagtagacctctcttggggtacttatttgggcttctattttgttgaaggaataaagtcatgctaatagatataggaggaggaagcaagataaacactcaggtgctgctgtaagattagtcacctccaagatttagactgggtcccaaatccctgaataataaataaatcagcatgaggagaagcccacaggtctcaaacatggagaggctggttaatggtagtcatgagcattccgaggcctgtgataacagaaaggcagtcccacttaatgctccaaatgttatgactgtagtttcaaattaactggcaaagtggcgcaacgttacagctgtaatagcgcagaggtcctccaatgactttctaataacagctgaaatcagaccgatatttgtgtggtctctgcagtttacaaatccttgcacgttgcacagtgcttggactgaaaagtatttgttaaataaatctacacaagatgctttccagaacagtcttctttaatcttcacaaaaatcatgtaaaacagagagggtaggagtaatttccaccccacagtgaaggtgattcagttcacagatacatggcttcattgtcactaacattcgttaggcactgaccatgttgctacacccagtttcatgtgctaggaatgtattaacatgcttaattctcataagatttcaatttggtgggtatgaatagtatccctattttacagataagaaaactgtgacacagaaaaattaagtaactaggacatgaatatgaatgtaactataatcagctataacaattagtaaccagcaccaggattgaacccaggtagttagcttgagttcacactttgaactacagcatctgcttggagacttgcctgtgtaatagcacctatgtgctctggccttggtcaaaaagctagtcaatggccaggccaaagctgtgcctgtgttctctccaggccacctccctgcttctatgagggcagttatcatttgcacaatgtcactcaggcctccccacaagtccactcaactgagcagggtggggacttataggcacaactaattctccctaggaacccaggtcaggaaggctagcctcagaagcaggacagataagaagcgcatagtgcagaggcatcaaccacttggaaaatactgggtatagttgggtatacctaggaaacaagctactgaagatctatatggcaggttcaacaaagtctctattatagaaccaaaagtctacttcaaaaccacagagttagaaactgttcttgaaggggagtttacattttatcaatcttggcttttaattaaccacatattatctttcagggaaacctcacagtcagggtatgtacaaaaaccctgtgtttccagaaatgaacgggtttcccaatgaaagaaagaaatgcacggcctgtctcacgtcagagcattcctgattacaaagatccctctgaaaaatggcataacctaacactatgtaaacacagccaatgtttagcaactattcaactacatttaaacatgtttacagggaatgcaggatgcttcacttgcctcacagcaaatggattcctaaagcattctgcaaagtgaacattcatttatttttccacacacatataaattggaataaaagattgtatgcccccccctccccccgcatatttagattttctctggtaggagaaaaatatcagtgaagtttcttgtggaaaatgaatcaacatgcatagtgattttcttcccagcatcccttccattttcaaagatggaaatgtaatcagatcctaaatgtgttgttaacaagacatacttactgagaaacttggtgtcagacttacctattggatttctatcaaagaataataccggagctttcagaattgactcaaacattttgttgtgcaaagtttgtgaagagttaacaaggacgtagaataccaatagagatcttgctatgccaaaaagaacggtagctacagttaaacctgaaataaagaaatatcacttagagaacacagcatatctctgcattttcttcaatagttgctaaagcaagccaggtagtttataaagatgttacttaatttattccataaagcatctggattctacataagtataatgtatttacaaaatacattgacaaagaaggattaaaatagtttatttttctctcactgaatggaaactgcacagaaaagaaaaatcaggtgtataatacaatttcattctaggctctaattcaattgcaagttctattaaaaactcagaagtaggatagataatcatgaagtgtagttgatcttctccatattccaaatcttattacttacattatgtcccataatctaaaaaaggtggtatgttttgataccaacatgtgatattaacaaggaataggagaaatgatttaccttttccttgtagaaaatgcccaagtagctttaaagaatttaaaaataccgtattaagttgcatgtggaaaacctcttgaataattgaattgcaagaaaacacaaattatattttaacataagataattaatctaaataagcaactaatcccccactgttttacatagacacaagacatttttaaatgaataaaataaatcatacattttattaagacatgaatgaggatccattattcacatagaaattaaaagagctttcctaacatctcttcattcacaatgctaaatacagtgggggtaacttctataacaaatatttccctttcagatgacatgtcactgttatttaacctctgaaagcagctcaaattcctaactccatcaacgggcattatccttagcctgccatcctacacgaacataatagaacataatagatttccttcttcctttagtttccacatagtccatcagttggaaggtaaacacctaacagatttagatttcttagcaagcgatcgatgaaataaacaccaaatttcactgagtaggttcttacaaagataactcactctatctctgaggaaagcttgtaggagcatttcctgtggaaatatttaaaattttagatgaagattttctttaaacagtatgtaatgctacatacattctaagcactcttgtgaaaacagagtgtggcgttaatattagtctggcaagccaaatgttaaattaatcacacagttggggacgcgataacattgtgatctcaaggtaagaaatagaaggcatcctaattcccagacactggatttttccctgctcagcttccctcttaagtaattagtgaagcccaggagatgagcagtgctgaagggagctttgcatacctgggagggaataatgcttttattttgggggccttgctgccagaggatttcatccaagttcaataaaagccagggtttatttagacagaattggaaccatccgaaccacagggtggagatccgtttctaatccccctgcccatccgtataatgatataagatttagctaaagcaacctattagaatagacaatagccacatatttccagtggctgattttctgaatgctcaatcctggtttaactttcaaaatccagtacagagcaaattaagagtcttcagtcaacctctcttctagtagatttttaaaataattattctaattaattcacagagtaaattcgactgagactcctgatctgttaagacattactgaatgactcctggaagccctagttactcacacaggctcattgtaagcacctcagcctctcatacaatacaccaaatgattaaactttacctgaataaattcctaagtaccagttaagatctagcttctcggttacatttcctcctccatttacagtgacatttagcatactttgtttgtttgccctatggaacatggggagaaaaaaatattaagctatatatgaaatttagataaatacatttttttaaaaatgaaccacaatttgggagaaacgcttcatgctggaaaatgattctcagctcacttagtcttgtgtatatctaccttataaaaattcaatttaaatcacaactttcagttcccgaaactgtctgtgaacatgatgccgcggatcagacatgggtggagaccaccgcagtttacactccaccagcaagcactctaatttttcttcgggtaaacgaagtgaggattagaagagaaggatcaacaaacacctccctctaactctatggaaaagcgagtcttcttactgattttggagtatttcatacatcagaccagaaataacttaccagtatgaaagccaccaatcttgaagcacataggcaacctaggaggggagaaacaacaaagacaaaaatcaaacttgggcatgacttaccaactcaaaactctcaatcgctaacatggacaaccgaaagaaagccctcaaagccgggcgtggtggctcatgcttgtaaaccccagcactttgggaggctgaggcaggcggatcaacttaaggccaggagttcgagaccagcctggccaacatagtgaaaccctatctctactaaaaatacaaaaattagcctagctgggcatggtggcacatgtgcctgtagtcccagctactccggaggctgagacaggagaattgcttaaaccccagaggcagaggttgaagtgagccaagatcgcgccactgcactccaacctgggcaacagagcaaaactccatctcaaaaaaaaaaaaaaaaagaaagaaagaaagaaagaaagaataaaaggctcagagaactcgcatagttcttccagctcaggtctgtgccaagcccaaactcccagatatcaagggttcaagaaaatgcatattccattttaaaatcattgaaagatacccttttttcgcaggtctttgtaacggacatggaacaccagtaggcagccctcactttgttccccaaagacagcacatttcaattcagaccccaagtgaactgcaagatgcagtcataatagcataaacataggtactgtaaatatcattttgagggcgcaaaacaaatgtcattatttacctgagctgcagtgtttaggagaataaggaaaatgaagacaatccagtgagcaccagctctgaagtaattcttataggcctgaaaaccaacttttccttcagaacggttctcctctgatagtgtaactgggacattctctgtctgcagaggaaaaaaggtggtaagagacaaaacagtatacaaaactgttcccaaagatgacaatgcactctgttgacaaagctgtggggaaacaggcagaagtccaaaatgatccatctcctgtggagaagggtgtggaaatagctagccaaactatacatccacttattttttatttatttaatttttttttgactcagaattttgctcatgtttcccaggctggagtgtagtggcgcgatcttggctcactgcaacctctgcctcctaggttcaagcaattatcctgcctcagcctcctgagtagcagggattacagatgcctgctaccacgcctggctaattttttgtattttttagtgaagacaggttttcaccatgttggccaggctgatctggaactcctgacctcaggtgatcctctcacctcggacttccaaagcgctgggattgcaggcatgagccaccacacccagctatatgcactaatccttggacccagccatcccactttcaaggttctactagagataaggaaatatcatttggacattgtggcgtggcttgctggaaggatgccatcaggatgttcagcacttacctagcacacccaaattcaagtgtcaatacagaaacttgttccaaaatcatatacaaaaagatatggaactctcaactgcatcactcaagatggaaacataaaagagcagggggtcaaaacatgagctcaacacagtaactggggtcaagcagtgagtctcagtaaccagagtttggaaaggaagggatagcatatgatcctaatctatttggttcctgagtttcagaaattgactcctgataatttggcatgtgagggcctaatctgaatatctgcaagaatccttcagtctcctggatttggatagtcagggtttgtgtggcaaggaatatctatgcttttaagtgagctctggtacatttctgcccggaggacttagaaggcatgagattcacatactctgaagatgtattgagcagctctatgctggccactgggaacaccaaggtgagtaagatgcagctcctattcttgaaaggtaaagaaggaagttgggctgctgtgtgtcaggaactgttgggtctttgcacatgctacttctggcctaactaacataaaccatctgacaacagggcaaaatacctccatcagccacctgcagcatcagaacattccaacatacaggaaaagtggctaatttcatgtggcccacagcaggactttctctaagggggtcttcaaattatgcctccagatgcaaagagaagtcgggggccaccagactaagtaggatttcactacagtaaattcaagaattgtagtattagtgtgagtcacacacagcttaggacttgcaccagcatacacacccgctactcacctccttgacattccccagcctacatacaaaggataactccaaccagggtggtttgccttggttccgttttaatctaccaatatcatggaatagagccctgaaaccacagaatccactttgggacaaaagatgaagctttgaacagagtagaccaaagatccataaggccattaacagtgaacaaaaccaggccatgttgtaacaggaggtgaactcacatcttggctctccagagcaccatctttcaaggagggtctagaagattgttgagaccaaaccgaagactctgagaaggtacgattccttagtgtgggagttcctggaactggaggttgttcactttcctcattatccttctttaaaagggagccaaaatctataccagattttaggaactcagtgtaagtccccttctgcaccattttaccctaaaataaaaataaagaatttcagagagatacatgtgcaggtgataatgttaacctaatctaattctaatccagaaaaagtaactgatcttaagttatgattatacttaggtccggaatcctagttgacaaatctaatacaattcaacttgatacacaactgagtgttctgttctcagccagactctgtgttaggtcctgaagaatatttttaaaatggtaatagtgtgttacaaatggcgattattatcacacagatgttggtgaccgtattggtagtcttattacagaacatgaaaactgtgataaaccttatgcaataagaattgaaggaatgagtaaattgaggaggatattccaggaaagaaacctaacactgatagggaggtaggaacaggcatatctgcacaggtaggaagcactccacaagcctccactggccatgggccctgctggaaaaaggcgtgtgggaaccagacttggacatagaccccatgaactgcaccttcacggtctttactctaaaattgccccacaggccaggtgcagtggctcacacctgaaatcccagcactttggaagaccaaggcaggtggatcacctgaggtcaggagttcgagactagcctggccaacatgatgaaaccccacctctactaaaaatacaaaaaaattagccgggcatctgtaatcctagctactcgggaggctgaggcaggagaatcacttgaacccagaaggcggaggttgcagtgagcagagatcaagccactgcactccagcctggatgacaagagcgaaactccatctcataaataaataaataaataaataaataaataaataaataaataattgccccaaagactcagggagttcctaactgaaaattcgacattccatgggacacaaccttgcacagttttctctccttacaaagtcatagaaaataatgtacaaatatctttactatttgtgtaccccatgaaatgagacccaactgatttcctcaaacagcagcaaacaaaatattaggcaaactcccagaatacaaaacaaatcaaaggagagcagctcctggctaaggcaagtcaggtgggggaaggtggccaggaccctccctgctaccccaatcctccccacccccaaaaggtgggtccactgaggaaaatccaacgacaccttgggccctttggaccagtttgataactggagaattcaaaaatgcttcatgatacattgtgtcttcttccacacaggaggtaaaagtgacacacctagtttgataaaatgaccacttttcacatagtatctgtaagacacacaaggaaactcctactggtactgagatggcaattttcctcagaagccgagtactgaggagcaatgcagagtgggttccgagggggaaccgtgctctgtctgctgttagggaaggggctgggtcgacagcaagaagcaagaatggacacacattcatcctgggtgcccaccagtggaaaaatggtttgtgtgtgtgtggtagggtctcagtctgttgcccaggctggagtgcaatggcgcgatctcggctcactgcaaccttcgcctcccaggttcaagtgattctcctgcctcaggctcctgagtagctgggatcacaggcagcgccaccaggcccagccaatttttttgtattttcggtagagatgggttttcaccatgttggccaggttggtctcaaactcctgacctcaagtgattccccccgacaccctgacctcccaaattgctgggattacaggcatgagccaccgcgcctcgccaaatggttgttttggagaaagattattctaccacccacagactttactctaatgtaccagcattcaggttttgccacactagtctcagccctctgcataagaaattacttgttttcaagtttgaggaacccaggctccctattcctgggggagtggggaagagccagcacacggaaccacttctgaagaggcagcagttctgccttcgataatcctcttaagggtgagaattcacttgccgggacttcagtggacagattcctcactgttctttaggcagcaaggaggggcttacacacaagacttgcaagagctttgctatcattatataccccgtttgttgcaataatgtgaaatttatctcccttggagaacggtgcacacagatcttataaaatataattaacactcgtttttgttatttccatcgttttattaagaaattgcaggaggagaaacattaaaacatttgaagacactaagcgggtttcagacccacaatcaggaatttgaccagggcctggaacagagaagggttaaggaccagggtactgaggcaagaggcaacaagccaaggagtgctgcatgaaaccaccgctgggctgagaagttctcactaacctccatgtccccggccacgctagctcttataggttgaatggtgaccatgaccccctaaaaagatatgttcgagtcctaaatcctgttacctgtgaatgtggccttttttttcaaaactggatttttgcagatacaatcaagacaagatgaggtcatactggagtagggtgggccctaggtccagtgactgatgtccttataggaagaaagccagagagacacagcgacaatgccatgtgacaacagaggcagagactgaagggctgcactgccagccaaggatcaacagtgagtgccagcaaaaccccagaaagtgggagaggcgaggaaggattctcccctgaagccttcagagagcgcggccctgcggacaccttgattttggacttgcagcctcagaacagtgagacaatacatttctgttgttgtaagctgcctaatgtgtggcactttgttctggcagccctaggaaactgacacactagaccaaccccttatttctgtcttgtgaaccactaagacttcaaattacttctgctgtagctcctccagccaacaacaaagaggatctcttaaaatcacagatcaaaccatgtcactccactgctctggactgtccagtagcctctgtcctagttccagggcctctgacaactgctctgagcccacctttctccaggctctccctggcttgctctgctcctccctgatgttcctgtaaatgcaccaggtaacttccagctttaggaccccactgccagtcccctgcctcagatgccctccccaggtgaccgcatggtcagcaccttcacgtcactgtacctcaagtcccagcgaggcaaccccacccctccatttccttccttgcatctatctccaggaagaatgtcagcccgacgatggcaaggactttgtcttacttatagctataccagctctcacacatatcaggcactcaaaaattcctgtgcagtgacactaactgctggctattccaggaaagtgggtgctgtgactaggggttgctcagttatccaactgtgttgctgctattattattattttttaatttttatttttttgagacagagtctcactctgtagcccaggctggagtgcaacggcatgatctcggctcactacaacctccgcctcccgggttcaagtgattcccctgcctcagcctcctgagtagctgggactacaagtgtgcaccatcatgctgggctaattttttgtatttttagtagagacggggtttcaccgtgttagacaggctggtcttgaactcctgacgtcaggtgatctgcctgcctcggcctcccaaagtgctgggattacaggcctgagtcactgtgcccagccatttctgctattaatagaagaggatctttagccaaactatgcatgacaattaaagggatacaaacaggtcttagagtctgtaatttccaaataatacaatttgaattaagtcatggaagaggtaaacaaaaagttctaaattaaaacagcatcattttctttaacaatgtagtaaccttgaggtagcaattttacatactttacggtaatatggtttagcatgtaataatgacatttctacaagtcttttgagttaatacttaaaaacatgaatcccagctctgagaagaaaggaacatgaaatggaggaagaagaaggggattcaacacacccaagtacttgcaagttcgggagacctctagaaactacttacatctttcaatatcagaatctgacttgcagctttgaggtactgcaactgatgagtcactaaaattgtgatcttctcatgcaaaatttgacaaatacacctataaatgtaaaaggcacagggtgaaaaaatgcatgaatggggtgctccacattgaaaaacatacattttgaaaccgtagtcaaagacaacacagtagtcaaagatctagaggttaaatacaaactaaatacaaatataagccaataaagccggctaggtcctcaaaaccactagcagcaaatacgagccttgctgtggtgaaatcctcaaaagttttctgggaaggaggcaataagtgtaattttttttcctaaaacttagtttaacatagacattcaaaaatttgacttaactaaaacactaattattttattgccgtgtaggattgcaggggagaaagaaagatcgaggtcacgtaacgacgcggcatttttcttggacggtttcttagatgataatttataatgcacatatcaacgccccccctccaccccccgcaaaaaggcttagattcttggtaacctttgccagagtgcattttccagactcttcttcaaaaataatactagatacgaaaacaaatgctagtgacatgtgactctccacagtattcttggtctcatccaggaagcaaaacttctctcattagtcctaaacagtctgaataagaaaatggaaaaacagaatccaaacagtccaaaccatatggctcaaagataagacccacctcagtattcaaccatcaagttttctgacgtttgtttgttttctacggtacccactcaaagttctcctacattgtaaacgtagactcctgggagctacaaaaaaaaaaaattagccgggtgtggtggcacacacctgtagtcccagctagaagggaggctaaggtgggagaatcacttgagcccaggaggtgaggctacagtgagccgtcatcacaccactgcactccagcctggttgacagagtaagaccctgtctcaaaaagaaaaaaaggagaaaaaaaaaaaagaaaaagaaaagaaaagcattaatctgtaacaagggccaagaacataactcatgctcaataagtgttagccctgtcctccagtcttcctcatatgcagccactgcttttagaaattcaggactgagaagtcataagcaagtattttagagacagtgcctgtgatcagaaccacaactccagactgcagatatgtaaactatcacttcatcctttacgtccaaaaggattattttttcccctttcacatatcttagtttggcttatttcaaaactaagttgttcaatctagtatacctcttcaggtttagtacttatacccctcttcaggtttagtactaaagcttttaatgaaactgtttccctttatatcaagattggctgccattagtccttttatatacatatctaaagggagatgttaatgatcaaatctgatgggtgctatgtccagtatcagccaactcaaaggtttcaaaatgttttcttcctaacatcttccattgtagatgagataatagaaataattacactaacattgtaattgatggcttgaaattttttctaaattatgcttcttaggcaaatctcaaaaaatactttccaaattattaagagtaaaaatcttccagtcatgccataaaacaaacaaataataagtgattgatgtagcaatgagctatttaactctaatcctacataaagactacattaagaggccagccacgggggctcacgcctataattccagcactttggaaggctgaggcagacagatcacttgaggtcgggagttcaagcaacacggtgaaatcccatctccactaaaaatacaaaaattagctggatgtggtcacccatgcctgtaatcccagctactcggctggctgaggcacaagaattgctggaacccaggaggcctgcagtgatccaagatcatgccactgcactccagcctgggcaacagagcgagactctgcctcaaaaaggaaaaaaaaaaaaaaaagacaacattaagagctgacacatacaatgttggaggtgacacaagtgagaaagatatagtcagttggtgcagtggctcacacctataatcccagcactttgggaggttaaggcaggaggatcttttgaacccaggagttaaaggccagtctgggcaacatggagagatcccatctctacaaaaaaacacgaaacttagccaggagtggtggtgtgcacttgtagtcccagctactcgggaggatcacttgagcccaggaggtagaagttgcagtgggccgtgatcatgccattgcacttcagcctgggtgacagggcaaaactctgtcaaaaaaggaaggaagggatggagggagggagagagggacagatacagtcactaccttcattcattcagttaagatacatttgctgagcactgacgaagtaccagggactactctaagtgatgaggatacatccactggtcaagcaaacagacaacaccctgagtcgtgtagggacactcactacacaaacacagaaaacacactattggatagtaaagtaaaccatgaagagacagccaggcaaaggttgtactttagagggagtggccaggaaagtcctctctgcaaggaggtgatgtatgagccatgagactatctgggggaagcattcctggcagatacagcaggtgcaatggtcccggggcacaaatgcgctgtgcaaaggcaccttcatgcattcgcagtctagtgcgggggctggagggaagaacacataggtggatcaagagcagctcattgagggctgtgggaagacagagaaagcgccatgccctccgaggagcagaagagaaaggcaggaggtaggatctgtgtctttcatttttctcttttgcccaggcaaactatccctggttgtccaacggcaggaaaaatacccttacagacaggcagacgtgagaaattcacacctccttccaggcaccccaaagaagtgtgcatggctggaggactggtcttgcatggcaagggttggaaaggtgaatggggcagactgcaaagggcaatttgccattcgaggacttagaactgtagcttaaaagtaggggagtcctagaggacctgaaagagggaaggtgaactagtgctgtgcctgaatgtttgtggccctccccaaattcctactgaaccctaatcaccaatgtaatggtattaggaggtgaggcctatttcatgagaatctgccaacacaaatggtattagtagaaggggccagcccagggaagctgccgtaccccttccacagtgacaagacagctgtctatgaaccagagcgtgagccctctccaggcaccaaaactgctggcgccttgatcttgaatcttgtcctccagaactgtagaaacaattttctattgtttatatggagtacctagtttatgctattttgaatcagcagcctgaatggactaagacaaataggtaggcaacagtgtgggagatctgattaggagactcaaagaggcaggggtctgagaatttgaggctttctagaacacaaccacatctatagcaggcaacaaattggattagcatcctttaatctaagtgaccctcactttttgtatgtgataaaatccacttagtgtttgcaacatatagttgtaaaacacaactcttaacaactctcgatatatattcatgattgaagtaaaactgttaatggcaaatagaagcgtaattcattcacttttaatacaaaacacttcacatttctaagcttcaacacaaccgccatctttcatagcatattgttcaatccaattttctaactcgttgagaacattctccagttgctgctgagtgatttcctaaattgcattcgtgctccctgccctaagtttccccaaagaatgtgattctgattagcaaacaacaattttaacaagcttgcttctaacaagcatatatccaaagtcattaatccttaaaggtgcaagaggactttataaatacctcctgtgttcaaatgaaaatctgagggagcttgtgcgatacgcacactgatactcagcaatgaaaataccttcctccttccccgcggcgactctaaacagcgtcccaccgggaattgttgtttgagtgataaagaactggtggggcctcgcgcaagactcaagcaagccacagaggcccttctcggcgaaatggaaaattcatcaaggcacaatgaggagggagcaggaaacgaggctctgatcagactgctgcggcaatgccaagtgccagcttatcctgcactctgcattcagaaagattcaatgctgccatccacgttttttttggttgtggaaaaatagacaagacataacatttaccatttacaccatttttaattgtatagcttggtcgcgctaagtacatacacaccattgtgcaaccatcaccatcatacacatccacttcatcatcccataccaggcacattttgcatacgcactctggtgggtaaacgttcaggaacccacgtagagccccatgctcagtggatgacttcatgtccaaacccctggaatccagagcccagagatgagttactctcacacagccgactcgctatccactttgctatccaggacttgttatggactgaaccatgctcccctcaaagttcctatgttccagccctcaccctagcaccttagaaattgaacagagaaccttttttaaaattttttttttattattattatttttgagacagaatctcactcgtcatccaggctggagtgcaatggcgctatctcggctcactgcaacctccacctcctgggttcaagcaattctcctgcctcagcctccagagtagctgggattacaggcacccgccaccatccaccactgatttttgtatttttagtagagatggggtttcacaacgttggccaggctggtctcgaactcctcaggtgatctgcctgcctcggcttcccaaagtgctgggattacaggcatgggccacagtgcccggccaacacagaacctttagagaagtaattacactaaaatgaggccatgagggtgggccctactctaatctgactggtgtcttttcaggaagaggagatttggatacagagacacaaggagaaaagggtgagaaggcagccatcagcaggccaagaaagccctcgggaggagctgcacctgcagatgcattgatctcacacatgcagtctccagaactctgcagaaacaacctgccgctgtggaagccccccagcctgtggcattttgtgagggcagccctggctggccaacacaggacttccagagctttctctcacggtaccttctctatcccccaccacaggaacaggtgcctgcctgctgtccttcccacaggcctcactccttcccgtctgcacacctctgcttctactatttctttcaaaggaattgaatcctactctcagccaccacaaacccttaccagcctgcaggaccacaggctacttccagccaagcccggccctcagtgacctttccaatctctgctgcccacttcttccatttaaaaaaaaagattgtcgtatgccaggtgtaggggctcacacctgtaatctcagcactccaggaagccgagggcagggggggggggggggggggggtggatcccttgagcccaggagttcgagaccagcctgggcaacatagggagaccagcctagacaacatggcaaagccccctctcttcaaaaaaacactgaatgagctgggcatggtggtgctagcctgtagtcacagctacccgggaggctgaggcaggagaatctcttgaacccaggaggtcgaggctgcagtgagctgagaatgcaccactgcactccagcctgggcaacagagcgagatcctatctaaaaaaaaaataataataaaatagattgtcctatattgaaatcccctaagccttggggtctgttgaacttttcccatgcacttagtcttgatccatgcagagacaaattccttatgggcaagaatgaaatctgaacttgtctctctctcactcagcccagcatgggtgcttatcttctctgtggctgactgccctcctctgcaagcgaagatgtttcatgcagtagcatctgcaggagcatctacctcagtgtgcgcagaagggttacaatgagtgggaaaggctcactgactttaacaaggcgaaaaacaggaagctgactgtggggcagatgtgagtgctgttttggcaaaaccagttcacaatgctttcaaaaaggccagtctagactatgtaggaagtgtcagtcggcacacatgagtttatagaatatacagaaaagattccagagtagttctacctccatggctcagtgtctaagcaagagccaaagaaagaaaatcccagaaacaccacgtaagagttgggagggaagccagattctagacaactagtttcaaaggcaagccaggcctacatgcctgtgggttttaagtgttcactctggtaagaatccatgaagcaacattagattcttgaaaccacagtctactatggagcaaatcattcttaaattctagattttactagtaggttatctccaaactgacagattagtatgtaaagagcaacaaagccttcccaagaaagccctatgttggtcccaaggacgtcacttctaacctgtcatagagaaatgatggaggaaaagagctgaaagacaaggctcaggttgccaagtgccacccttccattgaaaaatggagtaccatctttcctatctccggggcctggtccatcagcagtttcttggttatcaactgtaattactagtaggggaaaacttgcaaaatttgccatctgtttctcaactccctaaaacatgatacactccactcactgcaacacactgaaatcactttgtgtattttcctaccttgaccttgtatttctgcaaaatttctctaaaatggatcttcagggaagcaggggacagtgtggggaggggagcggacaccagagtaggatgagctgaaagccataaaggctttcctgagccaactcgaaatggctctggaaaagcagaaatgacttaagacacaaacacactcacagttcgaacaagtgtctgctaacttccgcatctactgcactgagaggatcgtccaggagatagatgtcagcatcttgatacactgctctagaaaatacaaagaggtatcagactctcacccaggaacatgacaactttcaacaactgggatgttcattcaaatgccaacagaataacccaagaaggtgcttcacacaggacgcaatacacagtaagcaggtcctatgtgctcaccaccactggaaggtatcaaaagacaccggcatagtggctgctgaaatgcaacttaccttgcaaggtttacccgtgctttctgccctccactcagcgtggttccccgatctcctatcacagtcagatcaccatcctccaacagctgtaaatcctgtatggacaaaggaaagaaggggggaaaaagagacttaaaacatgttcttcctctgttctttgtgttcttccaaagttatcctaaactttgcacattagttcttcagaaatttacatgtatttgatcaacagcaatggaaatatttcatagtaactaaattgtaagtttgaacctatcaaatacacagtcagggcacgttatctattttaatgctgtagcttttcatagcatttatgcactgagccattttaacagaaattttttgagcagcaactccttgtgaattcagcagcgaaagagtttccacagtgagtgacctgacaataaaagattgacacaaatgtaagaggtgataagtgctaagaaggagaaggaagctggcttagggagacagagtgacagagggaaagtccactttatatagggaggtcaacaagggctctgatcgagggggtctgagcagagacctgtcaggggatggactggctggcacagagtgcaggaagagtgctccatagaggaatgagcaagcacaaaacccatggggtgatacgtgcccaaggtgttcacagaagagcaatatggatgcacacggaactgcgagcacaggatgatggcaggggagggcagagacagaggcaagagaagccaagggctcacacccagggaaataggaggaaggacatgatctgatcaaggcaataattgagacaagaaacaacagtagccgggaccggagtggggaacaaggaagtgaacatcagtggtcatgtgctgaacaaattttaaaggtagcacctataggatctgctgatgagatgggtttgtgttgtgatagaaaaagaggaggactgcattggttttggtgtaagacaagggaagaacagggttaccatttactgagctgggggaaatgagggacgcagattcaagagataaaatcaaaaggttgattatggccaaactgaaatgctgaccggctatcctgacttgcggctggataagtgagtctggaggtctgtgctggagacccaaccgtgagggctgtcagcataaagccacgggacttactaaggaacaactgtgtcttcacaagccattttgcgacttttgcctcagctttccattctcagagaagggataacacccgccccatcttcacagtgatgcttaaggcatcacaatagactgacagaaaaaaaactgcaaagaataagagcagaaagagcagcccagtcaggaaaagccaaagggaaaggagcagagtgctcatgagacactgcacagactggttgcactaagtagactctggctccatgcaagaccccaaaaaacaaaagctaggaaggaaaacaagtttttatttgaggatccaaccaaagttatatttaaaaattatttaagaaataagttgacaaagcataatactttttttaaaaaacatgacaagaacatccctgaaaataacaggataatgatcaggtttaagttacaggacattacattagaaatctttacttggatggcctataattatcactagacagatcctagcatagacaaaaggtgtggagaacatcgctgggtattgactgagctgcataagcatcaacctaggacactacagagatagccctcttacagatcaaggtgtcatttctttgtctctactctgacaaagccggggagacaaagcaaatggcacattgagatctccatgacaagcaaatcctctgacctccctaagttctcattttatctcttttacaaaatatcctggagaaacaagaattaataaactcatagaatgccggaacaatctaaagtaagggtatgaactctctaagtgaaaaaaggatctgagttcattatcatttgctattgatgactatgacatattttctgatcaaaccaacagcaggaccccattcatagcatgaatcccactaaataaagtacatcaccaaatggaaaaaaacagtatttccattggaacccactccctggcagcccactaagacacacaggagtcccctaatactccaatctgaaccagatggcatcaaatgaaaggtagcaagtgccccattatgaaaattcattatttcacgttatctctttgttgagctcagaagttacactatctcttcctttcagttttcataaaaagacaacgcggccaggcacggtggctcacgcctgtaatcccagcaatttgggaggccgacacgggtggatcacctgaggtcaggagttcaagaccagcctggccaacatggtgaaactccgtctctactaaacatacaaaattagccaggcatgggggtgcatgcctgtaatcccagctacttgagaggctaaggcaggagaatcgcttgaacctgggaggcaaaggttgcagtgagcgagatcgcaccattgcactccagcctgggcaacaagagtgaaactccatctcaaaaaaaaaaagacaatgcaccagttaacactatctcttcctttcagttttcataaaaagacaatgcaccattttaagacagggtcccagccttccacacaaacacaaacacacattgtttacttggcctcattccattgctgatggtctttatataatgtgttaagtttctgtgccttgattttacattgttttgttttcattctcaaaatagcatcaagttgtagcagagcaatcttagccattttctagaaaagacactaaaaatatctgtctcatttcatgcagacagggaatagggaaggagctctctccccatgcctggtagtagcactttgagtactacaacgaccttgagtgttgttgacttggcaaactatttatggacacgcctcagacagggaaaatatttcaaaggatctgaagtacaatctgagtcaggctaatttcctagccatgattttctagtttggctaaagggaaacagttgagcagaaagcagaagtgctcccaatgggaggaaggtatctcatgcacgttaggtaccactcagtaaaattaaccaattatttaatctaccaccacctttactgaaatgcagacacagaaactagagaaaaaccatgacgtggctatgtgggtttgacgccatctaaccagaatcctaccatgtgcacatcaaccatggtgacactaaaggcagaaagaccactgaggacactatggggatggtcacaggggccaggcctgaggccccagcacaagaagaggccccagagtcagagagcagggctctccagctttgggccacaccttgcttccatttggaatggcccttcctgtcatagcttatcaacatcctattcttctttcagggcccagctcaaactcttctatgaaactaacctgcagtcccccaatcagaaaacatcactctctcttctaggttcctaaggctttgtttatatttcttaggaaggacctgccatattctgcctcttaatgtttatgtgtgtactcagcttcttgctccacaggtcagctcctggatgtaagagctatgcaccaaccactgttcctgatgcctggtgttatctctaaccttcatgacaacctgccaagtaagtagtgaccacacttcacagatgaggagactgagatgaagtgagagcacgtaactggactgaggactctcagttaataaaggaaggctggagtctgaaccaagctcatctcagttcacagcctgttgccctttcatatcatgcttccccaagtgcttgctagaagttacttaaaggcaatactgaaacaactcagaactcgaagtctctctatccatatacagcactatcagttcatttagtcaccctagttagattcacctcattgtatcccttttgtactcagctttaaaaaaaaagacagggtcttgctatgttgcctaggctggtctcatactcctggcctcaagcaatcctcccacctcagctacccaaagtactgggattacaggtttgagccaccacgccgggccctcagcatttatttcctattatgtcactaaggagtgatatggttctcccaactgagagattaacaacaacaacaaaaaggcataacaacagttattttatgattgtcaaggcaatctaaaaagaaaatgtccaagttggcaggaatgtggcaaatatgagaagaaattataagatagtgggtacaccaaaggggtttgtagagtcaagtgagctatatagaaaaacattaaactccaatttatcaattccatgcctttttggatacacactgcttaaaagtgctcaaggattaaaagaaactatgcaaagggtgacataatattaatacattgcatctattagggtaacaatatttttattattctcttatttactgtactatgtatagaaaccctatataaatatcaattcaaataatggaagttatatactcagatacattctttcaagcatgtcacatttcatgtgattttacccaaaattggtggctcttataattaagaaggcctgttatgtgcctagtaatcagatgctttaagttcatgatcaaatcttatcctcacaatagcctatgaggtgaatagtttattatctctattttacagatgacaaaactgaggctttctaaggttcagacgattagctaaaatcacacacctactgaagaggaactgagactcaatcccagagctgtctgaccccaaggcctcggattttaactactacccactaaagtatctaacattagtatgttgtttcctgaggtatgtcctgtcatttgctacgatatctctttgaataaataattagcctaaagcaatactgctaaatgtgaattactacttcctatcttattattttatctcaaatatatttttagctcgatgaacttataaatttacttcaactgtatctagtacaatatatctagttgctatcaacatatctgagaaatcttgttagttcctattttttcctctaggacttttttttttttttttgcgggggagggtggccaggaggggaatgaggaactatataaggcaaaatcttttatttatcttattaactgatttagagaaaagggcaacagctactatttaccaaaaacctggcatgtttgcattttacagacattgcctgcagtctttataatcctgctgtatctcccccatttaataagaaatgaaacagaggccaaacacccagagacgctcaggaccatttctgtccagcaggttttgattacacatgcaatctctgtacctacaagccagaataattccagtattgctattctctatggccatctaacacccaccattgacacgtggatttgaaaaggagtcggcaaatgatctcataactcattaagaggatccctggtttcttccagtcccctgctaaacagtcataaatggcatttgagaatggtagcaaaatttcttggaaaccatctcatcccatgtccttatttctcagcagagacatcaaaagcccaaggcaagtaatgtgacaagtccaaagtggacaccgagctggtcgtgcgcagtggctcatgcaaataatcccagcattttgggaagcaaaagcaggtggatcacttgaggtcaagagttcaagaccagctggtcaacacagcaaaaccccatctctactaaaagtacaaaaaaattagccaggcatggtggcgcacacctgtgaccccagttactcaggaggctgaggcaggagaatcactggagcctgggaggcggaggttgcaatgaggcgagattacaccattagactccagcctgggtgacagagcgagactccatctcaaaaaaaacccaaagtgacagcgagcaaatgacaaagctgggccagactcctgctctgttcgacttctccaccaccggaggcccaccgtcctaccgaggatggaaccatgcacagggggccagcagtccatgcttacacacatccaggaaggaaccaagaagtcgccatgcagcccagccctgaggggaccccattgccactggagtctgcctgccacgcagaagcccgcaggtgcctgggacactatccgagttactgggccagtcctcaaaggtggctacggaagaggctgaatggcagccactgtcctaacccccactttcccccagagactttctgatgtgggaaggagcaaggcagagctgggtgacctgggacctggagtctcatgtgggtatcagaagctgaacaggtaaaaagggaaggcttgaaaaacattttgtcccacattctacctttttatcaatcacctaattgttaaaatagttttctaccttataaacacccccaactgagaggtgcctggcagaggggaaaatggaatctggagctaggcaggtatggctttgaacttgaactgcaaatgttcaagtgagtcattttatctctccaaccctccactttaccagccagaagcaacattcaactcttgaaaccacagtcttgaacaaatcattcttaaattctagagtttactagtaggttatctccaaactgacagattagtaggtaaagagcaacaaagccttcccaagaaagccctgtgttggtcccaaggacctcacttctaacctgtcatagagaaatgatggaagaaaagagctgaaagacaaggcccaggttgccaagtgccacccttccattgaaaaatggcgtaccatctttcctatctccggggcctggtccatcagcagtttcttggttatcaactgtaactaccagtgggggaaaactagcaaaatttgccatctgtttctcaactccctaaaacatgatacactccactcactgcaacacactgaaatcaccttgtatattctcctactttgaccctatatttctgcaaaatttctctaaaatggatcttcagggaagcaggggacagtggggggacaccagagcaggacaagctgaagtatagtaattattttagggaaatgttagcaattctgtacaaactttgaataaaatgaaaattttactttaaaaaagcgaggctagcaatatcagaaaaataaacaaaatgaggatagcaatagcaaaggcactgggaaatcatggcaaaagattaaaactttacacagctttgtgtgtgcatatgtgtgagcgtgtgagacagagaaaaaaaaataagacctggtaggatctgaataactaggagcttgccttagcgcatcttttcctatatagtgtatactattcaataaaaatctagctcattactgctaacttaatgtcatttccgaaaatgcatcatctctcattaacaatagtccaggatgaagaaacagcccattaaacaagcaatgatttctctatccaaatcgccagcaaatactactcacctgattgacagactctgatattccagccattgttcaagcaaaattactcattcctcacaaacctggctggaagccttctgcatcacacctgtgacagtctgtggcggccttttccagacagcataaaagaacagtaggatgtccaggccacactgcacagggcctggggagagccctttaatgccattattcactgatttttatggcccaaagaaggtaacatagtatttatcagtatttaccattttttctatcttctagaacttatagccctctattaagtatgctcagttttcatcaactatccaccaggtttatgaaaacctcagtgtacaatcaaacacttcatcttttctgaaaacaatcactctcttggtgaaatgatacacaatgaaaaataaattttaaaacagtttcctttaaataataaattgcactgtaaatttatccatgtaaccaaaaaccacccgtaccccaaaatctactgaaacaaattttcttttttaaagggagtggagaaggaaacctgtggtttgagagggacccaagcaggaaacatcagccaagtgcacggtgcagacatcttccggagtctgacgcaaaccaatgggtaatgagatactaaagcactgtaatctctgcctagccggttgatgatagcaagaaattctggtgattttttttcttgagtgagatgtaattttttttcaaaagtgttcttatcttctagagataagtaataaggtattacagataaaatacaattacagataaaatacaattgaggccaagggtatgcatcagaagaatctgggttgggggtggagctagcagagggccaggggagagacggagttgaattggctacaagttgatcgcacttgaacttgagcaatgggtacaggcaggttcaagacacccttctctccacttttgcaaatttttataattgtccattttgaaaaaaagaaaagttaaaagtaaataaaacttcacaaaaccaaccaaacccccgaaattcaccctgtaaacatcattttcgcatcagacgtaaaaggacagagcgtgtgtgtgtttatttactgggaggaccgccttaaagtattaaataacattcaaaggtctttaaaaattaaaaaaaagttaataaaccttgttgttcaagtgaacactagtattactggacattcgagtacatgaaatccaaaagtcatcactcacctttttcagagcacaagcctttatgactttttcatatcgttccttttcgtatttcttcccaaataaaatattactcctcagagttcccgagaacacccagggctgctgagacacataggcaattcttccatgcacgctgaccagcccgtgacttggggccaattccccgagcacggcacttaacagtgatgactgaaacagattgtaaaaaagcacatgttcagtcaacactcgagacaagaataagccactgcaatgcagccttgcccagccctgggagcttgaaaaacaccattcattcatttaaaagagcacaggaagttgtgattaaaaattggaaataacataatggtccacataaactagtagtttataaggaatattaacaaaatagagtgtaacaatctactctgccctaatgagtttccctaaatgagtttcatgcccctaaatgaaatggtacacggaacaaagatcaactaagaatgtttacagcaacagagtagccaagcatgacatatatagttcatatatccaatactgaatgcattgttcctgcatgcgggtatcttttttgacaaagaactaatcctagaaatgctgtatgtaaataacatatcctggccaggtgcagtggctcacgcctgtaatcccagcactttgggaggccgaggcgggtggatgacttgaggccaggagttcgagaccagcctggccaacatggtgaaaccccatctctactaaaactacaaacattagccgggcatggtggcacgcctgtaatcccagctacttgggaggctgaggcatgagaatcacttgaacctagggaaatggaggttgcagtgactctagatcacgccactgcactccagcctgggtgacagagcgagaccatgtctcaaaaactaaatatacatacatacgtgaataaatgaatgaataaataaaaataaataataaatcctgtgcactaggaaggacttttatttttaaatacccaagaatcgtgtctctgaagagcaaacttcaattgttaaaccaccctatttgttatacacctacaactagatttattgcgttgctttagaatatatgagactaagtctgtacgcacgtttccttcacatcttctacaatgcacagacatgacgtgtctgtgccccccactatcagagcacttacgacactgaactgaaatcacctgtttgtatatctgtctcaccccagataccagaaacttctggagggcagtggcgtctgggtcttgattacaggtgtatcttttactcctaacacaggactatacacctggctacaggtttattaaatgtgtgttcatgtgacttggagaagtcatatcaaaacatgtttaaagcttttcagacaagccttcataacctccagatgtcttgtagcatctagggtcccctctgacaaaaagaagttcccactttcttagtcaatccatcctgcatagtggtcacataaataatttctttcatggagatgtccaacttctaggagttcccaattgctcaacttgaagaaccaagggaaacatgatatgcattgtccacatttatttggtcatgtgacccttcttgcaaaacgaatgttccatgcactgagaaatgccgtgccaagtgtacccagttcaaaattgtgttacacgtagccttgggctcaaacccacgaagttaatatgataagtggggttgcaacaagctgccaaaagccattctaactcaccttccctgctcccacggggccgaccacagctaacaattcgccaggtctgacagtaaaggaaaggccttgtagagttggggtctctgatgcctacaaattaaagtttataaaatgtgcccatttcaataaagtcacacaaatcacttcaaaaagagaagaaaacaatacaacagtcattgatacatgaacataacccaaatctttctccttcctattttaagatattgtatcctagagtccttttcatacaatcatatttttttggtggggttttacacagtttggagtcttcagtacttaaggaaggcccattcccttttaccagattttcatgtgaacacagctccagacttccacaaaatttagatagtaaaaatgacaagacaagcttcttgaaatgaaaactcatgctaacttactaaaacaatatatatatattttttactttaagttctaggatacatgcgcagaacgtgcaggtttgttacataggtatacatgtgccatggtggtttgctgcacctgtcaacctgtcatctaggttttaagccctgcatgcattatgtatttgtcctaatgctctccctccccttgccccccacccaccgacaagccccgtatgtgtaatgttcccctccctgtgtccatgtgttctcatttaaaacaatattctttttttttttttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcctgccactgcgcccagctaattttttgtatttttagtagagacggggtttcaccgtggtctcgatctcctgacctcgtgatccgcccgcctcggcctcccaaagtgctgggattacaggcgtgagccaccgcgcccggcaatattcttaatataatattcagtatgggagcttttcaaccatttgtaaattttcattctgtcccttggttttaatattctatttcattaacctccacaaggtggcagcatgagtacatggcatgcccagtccttggctaatggatgacttgaaatctccactaatctttccattttcacttgataaagcatgaacctcagttatgcccagccagccagaaggcactttatactataaagtcactcttggcaaatgaacttctacaaatggtggtcaaccctgtaaccaagagctctaatttaacaataaccaaaaactgaagaataatgaaattaagtgtatgttcataggtcaaagtgaaagtctcagtgttacacctgcagcttgtgttacccatcctgggaaaatagggacagcatagtagttctactataaacactgaggtacccaccacagcattcaatccagcacaaagggaggaagggatgaagtactcattagggtatcagaaataatgttcctaaacaatctataaattctatgataaaaagattcaggagtatatgcatgtttttacatatactaaatgttaacaaaattatcaatcactgctaatgttaaaaaaaaaaaagttgttttaggcagggtacggactggttcatgcctgtaatcccaacattttgggagatggaggtgggaggatcacttgagcctaggagttcaagacaagctggggcaacatagtgagaaaccatctcttaaagaaaaaaaaatcagccaggcatggtgtgtgccatagtcccagctactcaggaggatgaggcaggaggatcccttgagcaccggaggctgaggttgcagtgagccaagattgcaccactgcactctaacccgggtgacacagtaagaccttgtctcaaaaaaatgttattttgcagtttattatttaggagaccaaatcaaattcattacttttacaaagagcttctaaatattttcaattgagaggattaagtgtgtatcagggagaagggatagtttaccagagcatgatagggatagtttaccagagcatgataaaccaaaatgaggaggtttcctcttctcatacaaggacaatcagtactttgaattatctatcttttaaaaaagcaaaagtcagttggtacaaataaagagaggaatggttttaaattcagagtatagaacctcaaccgtaaaaactgccaactctaagaacttttgtccaaacccagacatcaacactagtagacaaaaattgatactgttaagtaaagtaaaaacagctacaatttgggaggaatcctaaaggggtttaagcagcacatttataatcttcgtctgaatttctcgtggatagattggagagacttgaccatgcatgtctggtgggtaggcatttagcaaatttattcaagtcccaaatcctttcggaagtggctattcttctgcacgacacactttggtaaatgctcatccatatcatagaaaaatgatcaagaatgaatcaaaggcaatgcagcctcctcaactctagaaaaggattcttcaaaatgaatctggcgtccctgaagggtggaacacccctgggatgatggaagagggaagcacgcatggagtcaaccaacccaaaacctaaagacactgagctggcgcagcccacagttactcatcaacccctctccacatctcaagcgggcatgtgcaattagtaaaatgcccaaaagacagaaagcacggtgggggaataagagatcaagataaccttcaaaatgaaaaatttacctggaaacgacttaatggtcacatatccgaataatcacaaatatttctataaatggtcaaatgctaaaatatgtgtgtatgaaaactgaccccttatgtgtcccataccacatcataggatggccgcagaccaaaacgatcatgatcccttttaagcacaaagaaattagccccagatttcataggaattatataacaaccacccagaataggtttctttactccttcatacatgcctaacaactatttcttttttaaaaaagtaatacattacctaaacacttggaaaaataacgttaaacaaaatgtgacatatttacacgattttaagtgcaaacttgtcacaaattcacaaagtcttgcttgacttcgccttactatataaggtgttcctcctctaaaatgtaacgggtctactctgtattcctgattaagtaacatctgtctcttaagacaactgaaacctacttatttctgtgattacaaaaggatgaaaaaacacaaccggtcaacctgtccctttcccctcctttgcagtgtgtctctttcctaacaactacttctgattttacttctttttattcagttttggctgcaaaagagtgagccacatgcaaaacccagcttcccatcaaggccctggttcttagagcaggtttctgccccgccgggaggcctgggacccagcactggtgggctgcagccagaagggggcagcactcgacagctcagaaggctaggcccattccctctgggacctccccaggctccaagacacactaaggcaggcagactgagcccccactctgtgggccctggggccagagcagtgaagaaagcagaagcaaatcccttccccatggagagtcacaggctctcacggggccacagactttacagcttcagcccaagcccctgttttataaatgagacctaggctggtgagaagaccttccctccaatacctgctggtctatccagcaggactgctgctggggtctctgtctttctccgaaatcccagcccagcacacccttctttcctctgcagcttctctccagaagcccgtgtctgtgcccctcctcccaccccagcaccctctcagccgcaggacctccctaataatccctgccagtgtgaggcaaaatcaccccaagacaaggccagaaaacaggatggagtgttctgtttacaatgcagctgtcaatgttatctaggaaccgaaaaacaacaaaacagaccattttacaatatcgcagggtttggtacaaaagaaatttgcaaatgggacctacacagtgtgtggtagctacctcagtgccttcctctagctcaacagcattcacctagagtgcttttttctagtgggatgttcacagagctgtctgtcaatgcttgaagtgtattagagctgggcacggtggctcatgcctgcaatcccagcactttgggaggccaaggcgggcagatcacttgaggccagaaattcaagaccagcctggccaacatgggagaaaccctgtctctactaaaaatacaaaaattagccaggcatggtggggcgtgcctgtaatcctagctactcacgaggttgaggcaggagaatcacttgaccctgggagacagaggttacagtgagccgaaatcacagcactgcactccagcctaggcaaaagagcaagactctgtctccaaaacaaataaataaataaataaagtgtatgagggtgggaatgccagcagataaagagaaactgtcaccttgtgtgagtttccatgtgcacaagatgcgatgatgttctaaatatctgggaacacattattgttttgttggtagagatggcagaaattacatcagaattaggcaaacatgaaacagggagtgcaatacttagagccaagggcatgtagagaaaggaagagtctggagtctagagagttttgacatttgtcccacaggggaggacggaggcagtggggctgggcaggagtgctgctcaaccgcctattggctcttggctccagcaaactacgctacaacgcaaggtcagccacaaagagcacccggagaggggaggagctggtcaccaccagcactgcccacctgttttaagcagcctgagctgttccagtaccctcagaagagaccctcgccctctgctcccaaatcttgctggcagctgggccactgggctctgctcctggcagacatcatctccagccccggggtgcagcttcctgccgtggctgatctcggggtggcctcctccacccctgctttccctttgtgctctttctttcatcacctatgaaacgaattccctgcacaaaattccctctcccatgctgtgtgttctgttttccagactaacacagactgagacaagtgcatttgcagaggaccccggactcaggtgagcgtaaccgcagaaccagcccaatctggttcaactttgtgtaataacatagtaaacagtttttcagtcaccatggatcccaggttgcaagttacgtaatctgagcattcccagatgaaccaagcaggcaaccatgggcagaacccaagtgctaggaccaaggaaggaggaacgagttcagaggcgaacgcctcatggcatgatccaggatccgatcaggtccagctctggcatcatgcaagacccaatcggaccatgcctcattaccctctgcctataaaacctgccccatcccccagctagggaagacaaatttgagcgttgcctcctgtctccttgccattccactcacaatacagcctttctcttcatgaaaagctggtgccatagtagtggcgtctatgagcactgggcagggagcccactgcttccttggaagcatgaggagggcactggagttgtggataacaggagatgcaccgagcctcagtacttcttgtgggtggcccctgctgttggtcccatttgcctaaatgttatgagtaaaccaagtgttgaaaaatccttgtggccttgccagaactacctgtccacttaccacacggtgaaacccttcagtcaggaatccatggagcttgctacgccggcctgcagcctcccctcggccttgggctgccaccaaagcagctggcaacatccagatgcttggaataggggagccccaccccaaccccgtggcaaaaatccaagtcatgggctttctcaatatgtaataagatgacctgaaaacgctaagctgaaaatgtgcactgataccccaaagtctccgtaataatctacaatgtactcagcagttaacccattccatgctgcacccctagtctgtccaatcctataaaatccagcgttgccaatgtccaaacttagtgacatttagtttagaacgaggtaacactttccttggttttttgaaaatgagataaaatacaacttgtcaaatacctaagtctgatttcatacctactttctattaattgcaaaacttactcctaattttgagaatctttgtaacatagtttcagtaaataagcaagccatattttataccatgtgtaacacctcaaaattctctattaaatcaatgtcactcattatcttcagcagtcatgatcttgcattaaggatatgttaccttatcccaaaaagcagtaaaatcctgcacatgcaccatctttttaccatctgacggcagctgacggttgcgctgtgatatctcatcaagtagcaaaaaggtctaaagaaaatgggaaaaacacagattgtttaaattacagaaacaaaagcacaaacaaaagtcactgcttccatggaatttgtaacataaaactttatacagcctacagatcattttaccaaccctatttaaagtatcggttcacatcagcatatgatatttatttaataaataaacatgtaaagagttcatggccatgaactatctttgtaattttaggaactatctgtgtaatttttttcaacaagtatacttgttcctaaataaaccgaaaatactgctctgagactgagtgcattgacagcctgcatagttctactgttgtacttttgtgttactaatggtgaacacgggagttggttggaaatgatctgatgaatatttcatgaatcctcatcatgtgccaagccccgcgctagatgctggcaacatgaaagtcaaggccattcccagccttcaggaagcaagtgagcccagaagggtaggcaggaaacacagggcagagcctctgaaggcagccctggctctggccagtcacttagattcaactggccttctcctccctcgtgcacgtcaaattgacatacaacttaattcactatcacttaagtcagtgttctttaccaaaataagaaaaaaggtttctatctcttaaaacatattttataagcttcttttcacaatcacctattattattgttattattattattttgagacagagtctcactctgtcacccaggctggaaagcatggcacgatctcggttcgctgcagcctccgcctctccggttcaagtgattctccagcctcagcctcccaagtagctgggattacaggtgtctgccaccatgcctggctaatttttgtatttacactggagacagggtttcaccatgttagccaggctggtctcgaactgctggcctcaagcaatctacccacctcggcctcccaaaatgctgggtttacaggcataagccaccatgctacacctacacttatcttttttccttagtcaatgtcccctcctagacagcagaacggaccaatctctcgcttattgctattttccacactagttagcaactacacaatgcaatttaactgaataaaacaaagtcctgttaaccataacaaacctaacataatgatatatgggaaaactcccttttgctcctcaaatggtaggcataattcagtgagagaagctacagtggcttagaaacagaataaacaacctagatcacccccaccccatccaaaattttgtagatgtggcaaaaactgtcagctctcctcaaaacctgctctaattttctgtgcatttttagccaacgcacagcagccttgaacaaggaccactctctccagcccccaacacagttagatgtagccacatgactttaagttcagcccaacagaaagtgacaacgtccaggaaacttcctatacagtctccaggccttggaagctgcctggacaacttcccctccaaaatccaggtggtgaaacttaatggccaatgtgatggtattgagaggtatttaggccatgagggctcctccctcattgcactccagcctgggcaatagtgcaagaccctgtcaaaaaaaataaaaggaaaggaggaaaggaggaaaggaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaagaagggagggagggaaggaaggaaagaaagaaaaaagaccagacccaatttcacaagtttactgaccggcaatcatttgtgatactgatacaatgttttcactggtcccttctccagcatcccccatcacaaccaaaccgttcccaaacaccactccctaaggatcttctgaaaacacctctgataataaccaccatgcttcaaactcttccatgacccagcagcactgacagtcacactcccaaagtagcctttgccttgattccctgagtattaatcccaccctgtctttgagggcccacctcaaagactaatcctgctgggaaccagctcagggtggctgcagctgggaccgaaactgagttatgtacagggcagagatgtgtcccccatcctgcacttacaaacacactcacctgcatgaacactgcactgcacacggggtcagctcttcacagatacatgctacagtcataaacagactgtatgatcggcttaaattattcaaacaatcagctatgtcagttagcacagcaacaagcaaaaggttatatatacatcttcttaaccttgtctagacagaataaaattctgattttagctgaagtgtacgaccaagacatcaaattcagtattctgtatgtgcaggtcagaacagaagttccccaccttcaaaataaaaaactatgcacacagtaaacctattgagcactggtcaataaacaacagatctgagtggagacagacatgataatagtttagtggttaaatgagactccactcaacacatgaacggcttgtaaagatgctggaggggctagctggactttctctagtcactcaggagggtgaaaaagctgaaatgacattgccaatacagcaatgaggtgcatccccagaaagttcacttggggaagtatcagacggcagaactgaagtcaaagagattgacttcagagtggacggttggcaaaaactgaagcagctttgtgaacaataaaacctcagagacacattttactggatgtggaagtcattgaagactttcagtgctttgctgttaagataagatctcttaaaatcctattggacttgcttaatgccaagaccatcaatcctttccttaataaaagaaaaacagacggaacttcttagacctaaaaacttcgcaataaaaccttcattttctgtacatggaaaaaaggaaattgaaaagtatgagtaagaaagacaatagattaaagacttaaatataaaacctcaaaccataaaaaccctagaagaaagcctaggtaataccattcaggacataggcatggcaaagacttcacgactaaaacaccaaaaacaatggcaacaaaagccaaaattgacaaatgggatctaattaaactaaagagcttctccacagcaaaagaaactctcatcagagtgaacaggcaacctacagaatggaagaaaatttttgcaatctatccatgtgacagagggctaacatccagaatctacaaggaacttaaacaaatttacaagaaaaaaaacaaccccatcaaaaagtgagcgaaggatatgaacagacacttctcaaaagaagacatgtatgcagccaacaaacatatgaaaaaaagctcattatcactggtcattaaagaaatgcaaatcaaaaccacaatgagataccatctcacaccagttagaatggtgatcattaaaaagtcaggaaacaacagatgctggagaggatgtggagaaataggaacacttttacattgttggtgggagtgtaaattagttcaaccactgtgaaagacaacgtggcaattcctcaaggaactagaaccagaaataccattggacccagcaatcccattactgggtatatacccaaaggattataaatcattcgactataaagacacatgcacacgtatgtttactgcagcactatttacaacagcaaagacttggaaccaacccaaatgcccatcaatgacagactggataaagaaaatgtgtcatatatacactgtggaatactatgcagccataaaaaaggatgagttcatgtcctttacagggacatggatgaagctggaaaccatcattctcagcaaactaacacaggaacagaaaaccaaaccctgcatgttctcactcataagtgagagttgaacaatgagaacacatggacacaggaaggggaacatcacacaccagggcctgtcagagggtgaggggcaaggggaaggagagcattaggacaaatactgaatgcatgtggggcttaaaacctagatgatgggttgatgggtgcagcaaaccaccatggcacatgtatacctatgtaacaaaccttcatgttctgcacatgtgtcccagaaaaagtataataaaaaaattaaaatagaaatataaaaatattttttaaaaatttaacaacacaatgttttctaaactctatgtgtctgccaagctctggtctatctatggtcaagactcacttagttccgatcagtatattgggcagaactattcctcctctcctgatgccatttttcaccttctcattgttcattaacacatccacgagaggcaaggaagaaagtgaacattggatcaattcattacactcatcatttacaacctccatttttagagaaataggaaaggaggcggaaccaggcagaccccatcagtgggtcttgtagcaaacatctgcacagttctaaagcatcccagtcttcaaagccaaattcatccccaaatctggtcttctagtattccatatttcagtgaacccaggtgattttgcagccataaggacgaaagtagccctgatccctccttctgactaatccctcctcttgccccacacccaaatcaggacatgctctcaatggctttcaaatctatccaaggctgtctacttggtctgagtccaaatcccatcatcatcttccgggactgcttgctgcatcagcctcctgacgtatctccctgcctctactctgggcccccaatgcattccccaggctgcagccagggtgaattgaaaatatgtggattttcttgaacattaagagctttctcacataattacccccagggaaatgcagggcatcagcctcctggctgccccaagccacctcccttcccaaacccttccccatctctctccactaccacgcacacaatgctgcaggctatttcttgagccttcgcaggaagcactacacctccacaatggcatgggcatctctaccaaagcacctcatggcatctcagatattgccttccaaagacaatgacacatgagcactgattttaattacgtggttatttattaacccccacttgatgattcccaggaggaagttcccagcaggaaggacttctgtgcattggcttaccattgtatctaagcatttatcacagtgccagcttaagctaggtgctcaattacattgtagagtcaatgactaagtgaatgaataaattccaaacttaacccccaaaagcctagcatagaccaaaacaggtgtctgcgtgcttcctctcaaatgattttagtcttaagttatcctgacgtcgtttctatttgctacacatattttgacctcatgcgtttttttatcacacaactagggcaaggtttcccaaagacagcatattttcagggacacgaggacactttctaaagatattgattgggctgagcgcaatggctcacgctgtaatcccaacactttgggaggccgacgcgggtggatcacgaggtcaagagactgagactatcctggccaacgtggtgaaacccagtctctactaaaaatacaaaagttagccgggtgtggtggtgcatgcctgtagtcccagctactccaaaggctgaggcaggagaatcacttgaacctgggaggcagaggttgcagtgagctgagatcacgccactgcactccagcttggtgacagagcgagacgccgtctcaaaacaaaacaaaacaaaacaaaagatattgggacccagccaatgcctgatgaagcagaatctccaaggtgtaataatttagttttaatcagtgcatcaggtaattctgatgaacttggggacaaaattttaaatgggttacaggaaccatccaggttgaaaaaacacaaagttctaaaggaagaaaaaacaaacaaataaacaaaacaaaacaaaacctccaacaatgacttcaacaccaccatgaaggagtttaccatacgagcgccaacgctttcttaccagtcatgcctggccatttgtttctcctttactgaaaatcactactgctgaactctaggcccaccctcccaccagaaactatgtacatgaggggaaattaaggtttcctgcccaagtcaaagatgcatcctttatctggacacagagcaccttgccaaagttagccactggaaaatgtaaaattcccagccggtcattttattttactacatgcatacatctatctacaggaacaggaatttcaagccttagacacaggtgagttgcattttggtgggaaaaaaataaaaaatcctaaggatttcttccctagctgcatattggaccacaattccctgaaaatcgtctgcaggatccctttcatgccacactctctgatgtgtgacataattcagcagagaacgacagtcatcacttcccactaaaataatgctcagttgttaggcattttccaaatctcatagatgtaatgaagctggaggttgacttcacttacacatcttctgagcacctgcaatctatacgtaatataaagatgaatgaggcactgtgtctgccttttgtaagtttagagtttaggaagggaaagaaatctataaacaaatggcttcaataataaggggaaaatgaggacaaagtcacgtatggagagcccaaaagaagagatgaggattaaagagtgtgtgatgggccgggtgcggtggcttatacctgtaatcccagcactttgggatgccaaggcgggtggatcacttgaggtcaggaattcgagacctgcctggccaacgtggtgaaaccttgcctctactaaaaatacaaaaattagctggacatggtggctcacgcctgtaatcccaactactcaggaggctgaggcaggagaattgcttgaacccgggaagtagaggttgcagtgagctgagatcgtgccactgcactccagcctagccgacagagtgagactcatctcaaaagaaaaaaaagactgtgatggtgaattttatgtgtcagcttggctaggccacagtccccagatatgtggtcaaacatgtctgggtatcaatgggaaagtgtttttcagttgagattagcatttaaatctgtagactttaaaatcctacataatgtcagcggggctcatccaatcagttgaaggcatttaagagaaaaaagacctacaaagaaaagggaattctgcctcaagactgtcctcctcagactcaagctgcatcatcagctcttcccagggtctctggcctgccagctgccctgcagattgcagacttacgtcacctccaagttgcgtgagacaattttatcaatcaatctaccaatctctctctgcatgtacatacacgtgggccctatcagttctgcttctctggagaactctgactaatacagacggttttctaaataagtgagacaaaataggaaatgacctccagacactaagtccaatccccttatttaaagacaataaaaccaaggcccagagagttggtgagaacccaaggtctgcgtcccaccccgccataccacctgttggggctgctctttgcccaattattttttatggctgccgcatggaagtgagatctgcattcaggttatgctgtgcatgtggggataagaatgtgcactttttttttttttttttttttttgagatggagtctcctctgtcacccaggctggagtgcagtggtgcaatctcagctcactgcaacctccacctcccgggttcaagcaattctcgtgccttggcctccagagtagctgggattacaggtgcgtgccaccatgcccagctgattttgttgttgttgttttattttttgcagaggcggggtttcaccatgctggccaggctggtctagaactcctgacctcaagtgatccgtccacctaggcctccaaaagtgctgggattacagacgtgagccatcgcgcctggccgcacttctgagacagattgacggcctgggctaaagccccggatcagccttttattaactgttaaaacgtggaggtgctattcaccctcctcaggcttcagtttctttatctgtaatgtgggaatgataggggagttacacaagtaaaaggagtgagtattcataaggcacttgggcccctccttgttacctagtgggtactcaccagctattacctgttcatataaagccccatggtcttgatcttaatcttcatttatctcataatggccaggaagacagactaattttattaaccaagtaagactgtttctatttctccacatggcccaaggaaagtccatttgtttcacagcctggaagccagtcaggaggctctttttttttttttttttggagacagagcctcactctgtcacccagactacagtgcagtggcgtaatctcggctcactgcaacctccactttttgggttcaagcaagcctgagcctcctgaggagctgggattacaggcgtgtagctcaggagctgggattacaggcatgtaccaccatgcctgactaatttttatatttttagtagagacgggatttcaccatgttggccaagctggtctctaactcctgacctcaagtgatccgctcacctcggcctcccaaagtgctgcgattatagctgtaagccaccgcgcctggccaggagggtctatatttaatgtcagacatggcccctctcttacaagagcaggtccaccaagtccaagagggtttgagatgcacagagggacacacataacgaggcagagactccgatccagtccactctgaaaaaaatccagctccccagagttaaggaccctcacaccccccttgaacaaggcctggtgttctgggaatattcaactcgagtctgcttcctcgctcggccttcctctagcttctagtgcaggctgggccaccttgggtctgtattgggccccagacttttgctaaggttgctgcttctgtccatccagcatttggtgcccattatgtgtccatcaatgctgagctgcaccgtactggccttgctcggcaggaacaaaagtaccaccaggctcctgagacctggccggagggcttagtagcatttgcttaaatcaaggacagaagggaggacaccccagccacacagagcaaaagaccccaaagtgggaacagagacgagtcatgtgctgggaaacacacacaggtaagccctacacctagggttcaaaaataggactccacaagaaacagagaacctttcaaggtttttggaatacaactagatgagtaaaagaatactgaaggaaatatcccacaccagaggatactaaggcagcaacataggtgatacagtttggctctgtgtccccacccgaatctcagcttgaactgtaatcgccataatcctcacgtgtcaagggtgggaccaggtggaggtaatcggatcatgggggcagtttcccctgtgctgttctagtgatagtgagttctcatgagatctgatggttttatacgcgtctggcattttccctgcttgcacttctccttcctgccaccctgtgaagaaagtgcctgcttccccttccgccatgactgtgagtttcctgaggtctccccaactatgctgaactgtgagtcaattaaacctctttccaatataaattgcccagtctcaggaagttctttatagcaatataaaaacagattaatacaacaggcaacataccatggttaagaaatcatggttctgaacagattcctagttctaagataggcaaactccttaacctattacaggagccagtttcattctctgtaaagtggggacactaatgcttatctccttcaattgtgaggataacatgaaataacatgtacaggcttccaagagccctggtccacggtacacacaccaacacctgcaatcacggtgaggggcagcaacagcagtcagagaattacagcagcacaatacacatgtggcccttccgtctgaaaaaggtgtcctgcacactcagaaagatactctggtcaaagtatactcctaagttctttctttcaagatgcaaaagctacatgaaaaaagtgttactgacctgcatggaccatcccttcacagtgttacctgaagctgttgtcagaaagaatggggataagaaatgaccctgtatggtctgttttataggtaatattttttatgaaatacaaacttgctaatcagtagtgggagtctgcctatgaatagccactatgctccagcctgggtaacacagcaagatctcatctttaaaaaacaaacttcatcataaaaaagaatcttagcttttatgacaacacccaccccattctctcccctaccaaaaaaataaaaataaaaaaataatcacagccagtgtcagctaagttcactcgagtctgtccttgggcatccatctctattaagaaccaggaataaaacaaagcagatttttgaaaagcttagacagtcaagttcttgccaagccctctcacaaagccaatttattttaattttcaacttattcataaacacacaaatacttgagcatacattatgtgccaggaccttaccttggtgatataaattatttgcccctggcaattgagtgacagcgacttaggaaaaggtgatggtgtgtaaagtggatgctatggtttgaatgggcatgcctgttctaaattcacaggttggaagttcaccccagcatcagtgttaagaggtggggcctctaagaggtgatcaggtcgctacggcagagccctcctgaaggggattagtgtccttacagaaggctggagagaactaaccaggcccattttgtccttctgtttcctccacgatgggaggacacagaggtccatctgggaagcagagagtggtccttgttacagtcgtacaaatggagcaaggcagtagaaatcaaccaattggaaataaagaagtctggcagagataggttcatcaacagtaagaaaaaagtgaaaagcggacaggaaagaaatggcagaggtcctaaaggcatgcacagaaattaacaaggaaaacatctacagaggaaagaacttattttcaaacagggatagctaagtgaagttgaggccattcttcctgaccaagaagcagagacccccagcaagctctttccttccagcccacagaagaatcatactcaactcatactcactactttctcattggtgttaacataagagatgaaatctatttgcttttcctgcttttagacagcttagacattttaatcacccctgcagttaccacctgtacatcaaaagccctgtgccactgctgtttatgttgctgccaacaaatgaatcacaatgcttgcattgtctttaccgcgctctatctaagatagggaagtacacacaacattctggaatggcggcacgttttggttatgagagagttaaatgtcattacactggaacatagtgatgctaaataaaaggagacatcattctacttcaaatgcacctacaactttaaaatggcatctgacaccaacctggattcttcggatgctgacgattgcctctgacaccctctcaatggctgaggggaagaagagggtaaccgtcagccgcacagccccatacagcgtcactgccacgaacacgcggctggctgtgatcacactgccgaggagcacgtaggtggtgaaggtcacaaacacgatgattttgcttgcactgaaaaatgaagccaaattcatccctctgaggcaggaacttctcagaatcttggaaatctccttcctgaaagagagtacaggtttttaaaaaagcagtgatgtcaaccagataaagtggctcacgcctgcaatctcagcactttgggagctgaggtggatgaattgtttgaacccaggagtttgagaccatcctgggcaacaacaacaaaaaagtgcaaaggtgagaggtggccaggaactacccaagaaatcataagaagtatcatgtgctggaatgcaacaactaatcaaatatttaatccaaaagccaaaaaaaaaatacatattttgttttttgagacagagtttcactcttgtcgcccaggcaatggtgcgatctcagctcactgcaacctccgcctcctggttcaagcgattctcctgcctcagcctctcaagtagctaggattacaggcatgtgccaccacgcccagcaaatgtttgtatttttagtagagacagggtttcaccatgttggccaggctggtctcaaactcctgacctcaggtgatccacccgcctcagcctcccaaagttcttggattacaggcatgagccactgcgcccagccccctccaaaatttctaataaaacaaagcacaactaacagtatttccatgcctgtttggaatgaaaaatactgattcatatagtttggtccaatatagatatgcccagtctctataacttgtccatttggctacattaatataaattatagttttattttaaacaccattattctcaaatactaacatcttagactcattgttgggatttgggatattcagaaacatttggaatttcacttttgtattagtaagaagcatacatgctttctgtttaagaacatggtaaatggaagaccaagtgaaaataacgttctctaccattctacttaacccaactgccaagcgtggggactgggatggattgtactgaacttcccataatgtgaaaacatagtaaaacttctaaaaccatcaacaagaatagcaaatagaaaaatacaaaaatatggtacaatgtatacaaaaacttactttctcaaattggtaataagatttgaaaatgacttttcccaggcgtacatttttattatccttataccagttataacttcattcatggtcctgatcctggcatccgtgaaagttgcagttttactcctaaggggaaccagacacgggagatgagcctgagcgatcacagcctgcccttatcagcggcaggcacaggcagggacctgcatcacatggttccctacagcgcttttgcttccgacaacacagacaggtcctactcaaaatacaaatagaaaaagacttcgattaggaagtcaacaatctataccaactcaacaagtattttggagaatttgtaatatctgctgaggaagacatgaaaatgagtcagatgtcatctgtcccctcgaggagctcacaggtgggcaggaaaggcagaaaggcacccgagcctgacgataacacagtggtcagagagtgctaaaatgggaatgaagtgctggggagcagaaaagaaagggctgtttgttaactccaccgggaaagaggagagcaaaaaaaaaaaaaaaagcttcagaggaccaggagcatttgaacggggcctcaaaggacaaggactatttctccagatggcaaagaggggaaggtccaagtagaaaatacaccataagcaaaagcataaaacaaagaactcaatgcacttccaacagtggctcatctcgatccagctgacaaccttgacaatgaaccatttccaattcgttggaacctgcttcaagtctaatttattttatcatcattaatctcttgatcaaaagctgtatttcttttttttttttttttttttttttttttttgagacagagtctcactctgtcacccaggctggagtgcagtggcataatatcggctcactgcaacctctgcctcctggattcaagtgattctcgtgcctgagcctcccaagtagctgggattacaggcgtgtaccaccatgcccagctaattttttaaatttagtagagacggagttttgtcatgttggccaggcaggtctcaaactcctggcctcaagtgatccacctgccttggcctcccaaagtgttgggattacaggcttcagccaccacgaccagctaacaaccatattcctaacacatatgctactaggactgtgtgattttataactacatcattaaaattcaccttgcctttggggagcttacaatttaatggaaatactgaattaaaaataacacacatatatacacgtgaaaacagctctaacacaagcacggtaaagatgtatgcagctagaatggagcctatgaaacatttcaatttatcattattcattatatgtttaactaacttctacatatgtgatttctgcttaaggacactctacttattgaggccacagcgcctgaaaagctggctgggaggagccagtgaatgccttcacctttctcccttgaagatttgccttcagcataaggacagaggcccccttggctgagcctgaagagctgcaacatatgcaaggaagagataataaaaggcatttagtttgtttctgaacaaaagcattgggaagactgtggatgttaccaaatacatatgacatttttcacagcagtatttctcttacctcagtgatgagaacaacttcccaaaacagctttgcaagggcaggagaatgattagaactgccatcccagcaaggcacgatattcctatctccatccagagtagggcagtcactgcaatcgcctgcagtggtcctgcccacaggaagtgtaagaacactgtcacctttaaagaaaaagacagagcgttcttaggactccagaaaagcaaaaccagtaagaacacagtacagaaacgatccactggaaaagaacaggcaagatcctaaacagaaatggccacagtgggtttacacctgctaaagcagaaagccaagcacccaccacaggtgaagccattctggggaaacaaagagtgggtctgggagactcgcaagagaatccgaccagcggcattagaagaatgtcttgatcgtgactatcttcactgatgagctgagcattttccagaactctctgccacagaattcagctcccatatgccctggggctccccagtaccccaagaaaacctgtactacagtgcccaccacatactccagtaatttacttgtgtgtttgtctcccagacaggcagtgagcttcttcagaacagaaaccaagtcttattcattgtccctgacactgagcggaggctttagttcattctgatgaatgaataattggaaaaaagaagtggtcctagtgcaaaatgaatatggccagcagctagaatgccctggaaaaatgataccgctacaaggtaagtattaaacaatggatactgggcgggtatggtgttcacacctgtaatcccagcactttgggaggccaaggtagcgagaatcgcttgaggccagaatcttgagaccagcctgcgcaacaaggcgtgatcccttctctacaaataataaaaaaagaaattagccagcaatccttttgtagttcatgagcatgataatcgggtgttcacgcacttgtgtgagatgtgccacccttgaattttgttatgatgtttccacaatagcccatctgacatgaaaattcaaaaaaaaagaaattagctgttcacggtgatgcacacctgtagtcacagctaatcaggaggctgagacaggaggatcgcacatcacttgagcccaggagttcaagccttcagcgagctatgatcctgccactgcaatccagtgtgaacagagtgagcccctgcctccagaaagaataaaaggggaaagaggggtgtttaatgcaatgaaaaaggatccctgagctgcagcttacctgatcaaacttgttcacatcattggacagcagattgactatctggcctgtggttgtcttccccatggccatgttactaagacgaagtgcctgaaataaaagaggtaagtagagaattgtattcatgcagtgatactaagtcaggcttaggacacagcagacctgaggaagtctcgtgtgatgtcaagaccagatctaagcacaagcatccccacccccccactgccccctctctctgccccaccagcacctttagtggtggcagctgtgtcaggacagcaaagcgagaggtaggaagaagaaaaatctcccacctcatttaatgaatttggacacgcccccaagtacaaaaggacataagtttctacttaagagccaaccaaagtaattttgagccaaattagggaagaacagagaggctgtcagaggaacaaaatgagaggacgtggactataaatccgtaccaatcactaattctctgtgcaacattattaaacacatggggccttagtctcttcaccctgcctggatcacagggtttcaatgtgttcaatgggaaatgacaaatatggagtatcaactatctggaggacaccaggagccccagcagatacagtgacacagtcatgttttcctgccttgggagacagggctaggtatgtccagacacctgtgattcaactgtgacctgcacagagaactggggacagttcgaactgagggacactgggtgggagagaccctggacgatgaaggagggactttatggagggaagggaagggcactgcaggggaggcctagctaggacagaagtacggagaaggaggatgtggaggctgctgaataaagaacaccccaaacctggctgaagcaggtgaagctcatggaagcggggctgaaacaggtgaagcttatggaaatggggctgaagcaggtgaagctcatggaagcagggctgaagcaggtgaagcttatggaaggcaatatggaacagtacgtgtggtttttcaagttagagggagaaactcaacttaaggaaggttaaacagtagaagcaattggccaggagactactggaaggaggagaatgagttgccgctggaataacagtccaggcaaaaggcaacaagactgtcaacgagggctatgtgaatgggaaaaaaagggccagatagaagtgaaaacattttgaaaagttaaaaaatggccgggcgcggtggctcacacctgtaatcccagcacttagtggggctgaaggcagatcacttgaggtcaggagttcgagatcagcctggccaacatggtgaaaccctgtctctactaaaaatacaaaaattagcttggtgtggtggtgtgcacctgtaatcccagctactcgggaggctgaggcagaaaatcacttgaaccgggaggcaggggttgcaatcagccaagattgcaccactgtactccagtctgggtgacagagtgagactgtctcaaaaaaaaaaaaattaaaaaatgctattatgcaaatataagtgaatcaatcgtaaaatacaaagaaagaagaaaatgtaggagtgagggagaagaaagggaaggagagagaccagcccgcccctgtaggaaagaaacagaacgtaatgtgccttattgactacaaactatctgtaaatatttataaagccagtcttacatacaaaatgttaatcccacatgcagaaaataccacatttttaaagcatgtaaatttgatacctaattttaaaaaaataaaagcaaaatgtcaacaccaaactctaagcctaagctgacccttttcaagaaatctgaagtcaattgtgcccaacttgaactatcatccacagattgtgtctgaggccaacaatgaggatttaggtaagacagcacagatgccaatttgtgaaaaagacaaagttcttctgggtgcaccaggagggctacttgtaagtcgtgtattactgtgaccaggtgtagaggtggaataaaaggctgggcagatactcgggttgtaatagaagttaacccaagtgaacgataactctacagtcaacacagaaattaagggcctgctgaaattaaatcagtcatactccagataggataaaaaaaatcatgaagggccatgaatattattaatgaggaagacatgccaggtgcggtggctcacacctgtaatcccagcactttgggaggctgaggcaggcagatcacctgaggtcgggagttcgagaccagcctggtcaacacggtgaatccctgtctctacaaaaatacaaaaattagccaggcatgatggcaggtgcctgtaatcccagctactcaggaggctgaggcaggagaatcacttgaacccaggaggcagaggctgcagtgagccaagatcgtgccattacactccagcttcggcgactgagcaagattccatcttaaaaaaaaaaaaagaggaagacacagctgacaagcaaactaccaggcttctgcttccaaccatgagagaggacttgccctcccctggaaaactgtaacgttgggcaaaacatatgacacagctgttttcaggcactggaccacaggtaacacaggctgtgagcctcaagagacgggaaatgtaggtggtggcccgggactgacctggctttatgcctgaggacattttctgcccaagcaaaacagtttcactgagcggtggaggaagagatggttgttccaagttgtagaagcatctggaatttgtgagcctgagtagcagagggtttgccccagaagtttcagtagggatttacccagggtactttgccaacggcttcataagcagggccagactccatgaggcctaggaaagcagcagctatggggctgagtgctgaccgaagattctggaggtcatgcagtaggagatgccgcccgaggagaggaaggaaatctccactgggcctcaggcattcacctgagacaccaggaaggctatgtcttagtaataaagatctcaccctagattaacagctgtgcacttggaataagttcagaatggagctacctgccctatgattaactgattgacagacagacagaaggattcaatgctaaaggggccaatctgccaggaatttaactacctgcatgaacaaaactcaatgctctttaatccagactccctatagtatatcgatcataatgttcaacatagtaaaacaattactagatacacaaggaaacaataaaatgtgacctgtaatcaaaggagggaaatggcaacagaaatagaccctgaaatgatccagattttggaattagtaaacaacaactatgaagcacctattataatatgtcaaggagttaaagaaaaatatggttataacaagtagatgtgagtttaggagcgagataggtaatatcaaaaagaaccaaatagaacttctcaaactgaaaaggtaatacctgaaatgaaaaataaattagatatcattaatagcagatactttccattgatttattcccagagtcgctaacccttccttctatagtttacaactgaaatctgaagaacaaacagaaaaaaagagttaagaaaaagaacaaagactgaatgaaggtccttatggaagaatattaagcaataaaatattcatgtaattggagtcctaaaagaagaagaaataggggaagaaaaaatatttgaacaaataatgactggaattttaccaaagttggtagcaaatattaatttacataatgaagaatcttagcaagttcaatgaaggacaaaaacaaagagatctatacctagacacacattaaacacagagaaacaacaaaaacaagcagaagctgacacaccagaaacaatgaaaacaagaagacaacagaacaatatttacagtgctgaaagacagacaaaaataactggccaggtgcggtggctcatgcctgtattcccagcactttgggtggttgaggcgggcagatcactcgagcccaggacttcgagaccagcctggccaacatggtgagaccccgcctctactaaaaatacaaaaattagccgggcacagtggtgggcacctgtaattccagccactccggaggctcaggcaggaaaatcacttgaacctgggaggcagaggttgcagtgagccgagatcgcgccactccactccagcctgggtgataggtgagactccaattcaaaaaaaaaaaaaaaaaaacacctgtcaactctgaattctatcaccaacacaaaatgtcctttaaaatatgagggtgaaattaggacattttcagaaaaaggctgagagactttatcagcaatgaacctgaactgtaaaaaacagcgtaaagaatacttttcaagctataaggagatggtatcaaatggaaactcagatctacagaaagaataaagagaaaccaaaatgaccaatgtgagtaaatataaggacaggctgggcatgatagctcatgcctgttatcccaacattttgggaggctgaggcagtcaaattgcttgagctcaggagttcgcgaccagcctgggctccacaaaaaatataacaattctccaggcatggtgccacacacttgtagacccagctactcgggggctgacgtgggagaatcgcttgaacccacgaggcggaggttgcagtgagccaagatcacaccactccactccagccggggtgacaaagtgaggccttgtctaaaaaaaaataaaaaataaataaaaagaagacaaattactttgaaaaacaactagctgcttagagcaaaaatggtaatggtgcattttggagacagaagtaaaatatacgacaatagcacacaagatggggaaggtaatagaattttactgttgcatacttctaacttttaaggtaaaatagtccttatgttgggccgtcagtaaatttcaatcaatatctgaacataaaaatgttacacagaatgtattctggtgacagcagaattaaattacagatcaacaataagacatctctaacaactcaaaatatctgaatattaacaatatttctaaataagcatgtgtcaaagatgacatcataagggaaatctgaaatattttaaagtaaatgataataatttgcgagttatagctaaagcaagtcttagagtaaacttttggctttaaggactttgcatttaaaaagaaggcataaaattgataatcaaagttctacctaaaatcaacaccaaagaaacaaacaaacaacaacaacaaaacactgctcacatcctcagaagtacaattagtgtaatcatatatctgtgttaccctcagcagctaccagaatatatagaccaagtcatattcatttatgtcattatgatcataaatcaagctaccatttagtaagcacctactgtaagccagacaactgaacaagaaaacaactatgaagtaagaattattcctattttgtagatgagaagataaaaataaactcaaactacttacatctgacagagaacaagcaattattttttcaatgaagcaaagttaccagtgtttctcattaatgtagaaaactaaagtttggttccaataaagtgtccatgttatagtttaaaagagttcacatccaatgtacagaaaaaatctgtaaattaatgtatcatcgttctgcaaatattttgattctatgcttcattaacctgacaggttataaaaggacaccattagattaaatttgttttccctgtgaaaacaaaatagttctaccatgagaacaaataaaaggcaactaaaacaaactgaaatcaaaacctgtagtacacatcccagacccaaaatatctttaataaatcaacggcccctacatatcgatatgaattataaatgcctaccaattattttttaaaaggagcaaagaatgtgtgcaggaaattcacaaaaaaaaaaaaaaaaaaaaaaaaccagcacaaatggccaaggaaatgcaaatgctgaaatccactattacacaaagccatgtaaattaaaacaacaatgcattatttttcacctatgaaaattggtgagattgacagtgattattaaaatataacatcaaatctggacttgtagggagctctctcatttcaccggggaaaatgtaagtaattaacaactcttggggaggaaatcaatctagcatagcaaaagccttgaaatttgtacgccctaggaaatgaaggatctgtccaaatgtttagctttaatcatgtccattaaaatgctatttgtaatatacaaaaactagaagacatctaactatctaattactaaaaactggaaaacatctgagtatctaattattggttactctagaatccgcatgccattaagaacaatactgtgaatggtggaagtaaacaccatcagagcagggcaccatttgatagctgcttactactgaaggcaggcaaggaaatacatttgagattacaagaaaactgtactatctagaacaaaacattaattgtattcaatttcttaaaaataaatcatgtaatatctagcttcatttgaaaaatataaactgtttcttctttcttgattattttaatcagtgtggccacataaatatcaccatcaaagggaggtggaaggagagaatgaccttttcatggaactgagttttccagactggtgagatgaatatccctttttggattaaatgcattaatccaatcttcattttaacagatgtctttcccccctctctaatagtccttttaaaacagaagatgcggctgggcacggtggctcatgcctgtaatcctagcactttgggaggccagggagggcggatcaccttagatcaggagttcgagaccagcctggccaacatggtgaaaccccgtctctactaaaaatacaaaaattagctgggcatggtggcgcacacccctgcaatcccagctactggggaggctgaggcaggagaatcgcttgaacccgagaggcaggggttgcagtgagccaagattgcgccactccagccagggtgacagtgagactccttctcaaaaattaaaaaaataaataaataaaacaaaagatgcaaaccgcagttcatcaccttcacgatgcaaattcctcacaacaatatggctcttacccagtgtcaatgacccggggtggacagggatgctcctctcacagagtccccaaatggccacacttttcggattcgggtacttcctgatccatcttgcccctggctgtcaggctatcaggtatctctttattctcatcagaatgtcacaccattacctactagtgttttagactaggatgtggcttttgagtgctgtaagtaaagtcagagtaaaaacgttctgaataagcatataaagtaagtattatctatcttatttattttatgttttgcttacttcctggttcatgaccctaccccagagttgagtttgtgaggtaatgaaacttccaattaaactgggtatttctgcaacaggcaactaggatgagtatgtttaatcacttgaagcagaaaattgcctgtatttttccaatactgttggccagagttgcttagtaacaacatatctactttaatgactgcacaatctaaaaccaataatctctgtttctgaggggatgatccaaggactggctaatatcctccttcctcgtaaacatgatgggtgactaccaaagtcacattccttctctaattctgtaaaagaaatgaaatttaaggagatgaaaatgtccatccaaaatcaacaacctgtatgttctttataatctgacagtttcactgccttctgaggcttttgtttgtgtttcacctgatttttcatggctggaatacaagcctgaaaacctatacagaaagttctccgtaggccaggtagggtggctcatgcctgtaatcccagcactttagaagaccaaggcggcaagatcacatgagcccaggagttcaagactagactgggcaacgtagtgagatcctgtctacaaaaaaatttaaaaattaaccaggcatggtggcacatgcctgtagtcccagctactcaggaggctgaggtggaaagatcgcttgagcccaggagctcaaggctgcagtaagcagtaatcatcccactggaatccagtctgggcaacagagcaaaaccaagaaagaaaagaaaaaaaaagaaaagaaaagaaaagagacagacagatgagagagagagaaagagagagagagagaaagaaagagaaagaaagaaagaaagaaagaaagaaagaaagaaagaaagaaagaaagaaagaaagagtgagaaagaaagaaagagtgagaaagaaaggaaggaaggaaaagaaaagaaagggaaaaaaaaccattagcgtttcaatgagtggtggggcagtcaatatacattgaaggaaattagtacaatctaattagtcaattctaccaatacccatggaaagaacatgtaacacagtttgagagtaatctgttcaaaggggggccacatccccccaccatggctgaaagacccctcagccccagaccctgctatcaccagtttctttgcctgaaaaacaagccccaactgaactggtttatcgactgagaggggaacagagatgagcaagacatactggcagggcaacaggaagaaaaaggaaaatatggagagggtgacaagccagggagtgggtaaagaagggacagtgaggacatacatggggacaaatacatggtctagggttaggtcagagaagatcatcttaaggagaatataaatgcagtatacccccattgaagaggaagaaaaaaaccaaacttctgtcatctttttgttgtgtgtgtgtgacagggtcttgctctttttgctggagttaagtggcatgatcgcagctcactgcagcttccacctctggggtccaagcaatcctcctgtctcagcctcccaagtaagagactataggcatgtgccaccacacttggcttttttggagggtagaacagggagggccgaggcagagacagaatctccctatgttgtccaagctggtcttgaactcctaggctcaagcaatgctcccgccttggcttctcaaagttctaggattagaggtgtgtttggcatccatcatcattttttaaaaatcttttttatcatgtttttcttctttctgctttttttttccccccgagacagtttcactcttgttgcccaggctggagtgcaatggcatgatcttggctcactgcaacctccacctcccagattcaagagattcacctaccttagcctcccaagtagctgggattacaggcatgcgccatcatgcctggctaatttttttttttttttttagttttagtagagacggggtttcaccatgttgatcaggctggtctcgaaatcctgacctcaagtgatccacctgccttggccttgcaaagtactgggattataggtgtgaaccaacgtgcccagcctgctttctgcttctaaaagaatattataagaaacaaataagaaatgtgtttataatgtatcttctcaaatatgacatgtttcatgtgccgtctttaagactaagaatacttggaggaagcaatcttcactctacagactcaccaaaattttactaagaatcagtcaaaatgaaaatattttacatacgtgattttccttttttcctaatgttgtgtatttatcaaagtattgaccttgagtaggccagatattcagtaatccgaaagtaacagtacacagtactgtaatactgcaaaattcattccatcattcattcccatttcaagattatctttgaagctttaagaaaatgaagagatttgtgcagcaggaaaaaaaatgacagatgtcagaaaatgtcttactaatgacttattcactaacatacatttttacaaccaaacataccaaatgcagtaatgccttcatctctttcactgatgaggataaaggaattaggagaaaaatgcacagagagaggagggacagacactctttaccaaggtacctccttcccactttctcgactctatgataagcatatcaaataacagccctgtgcccacagctattacccccaggagagatccaaaagagaaaatgaccctgttccttcagctaatgggtcccagagggagtagaaaggagaagatgaggacttcaaaacacatcaggacacaggcagttgctcagagcaagaagccagaaaagggtagaatctcagaaattctttcctcttccactacagctaaataaaggttcagcaccacagttgaggatcagggtgaggcagaagtttttcactaaatgctgagaaaatgtatgacataaaccccaaaattaaatttacctgaggacatgatgcgaagtgagataagccactcacaaaaggataaatatggtatgatcccacttggatgaggtcccttcagtaatcagattattacagacagaaagtaaaatggaggacaccagaggatgacaggcaagagccaccatgccttgcaaaaattacaaattttatgtgacagatatttttttgagacagggtctcactccagtgcccaggatggcgtacagtggcacaatcatggctcactgaagcctcaacttcctgagctcaggtaatcctcccacctcagcctcccaagtagctgagactactggtacacaccatcatgcctggctgatttttgtattttttgtagaaacagggtttcactatgttgcccaggctggtcttgaactccaaggctcaagcgatccagccatctgagcctcccaaagtattgggattacaggtgtaagccaccatgcctgaccgttatgtatattttaccacaattttttttaatttttagtagaaaaagattaaaaacaaatcaattatgtttgaaggcctgacagtaaataagcacaaaatacaaattctaaacctagagaaatatgttaaaaaaaaaaacgagaaataaaaacattttcagggcagggcaatgaaaaaatgtaaaaatttgctataacaggatgtcttagaagatagaaaaaaggaaaaaacagaaaaaaaactaaaatttaaaaactgaattaatatttttaaaaaataaataaatcattggccatgatttcaatataagtcctggggaaaggaatgcagagcctcatgcggccctttccctttcaaggaagccacgtccagcctccctctccacacctgttgttcccttcgccatcctctagtacagaaacttccctgaggcacaaattaaatatacagatttccaggccctttctctagaaattctgaaacagcaggtcaggtctgagatggccccaggattggggtttttgttaagcacacaggtgacatatggcagatgctggagcccctcagtcttgcatatgccctcaccctccatctattcagtaaggaagttaaacaggcatgtcctacagctcacacaaccacaccctatactgtacacttggagctcccagctccacagctcataaacatctgggctattcaactagcagagagactgggctctggccacggctaagtggctcataccataacggcccactcctctgcctcagaactgtacaacactagaaggcagatgtctccagacaccaagcattgccttggctctgagctaggacaccactttccgactgtggcagtgagctgaagtccaaacacatcacagcagccctgctgagcaaaggggtggaggccagagcttgggttagttaaagccactggcatctgcatggccctggacagtaagcaggtatcagaagggaagggccccagaaggctgtggggtgggggtgctacaagtccttggctgatgcgcgggcacaggtcaaggccgcccaagccttaacagagagctggtgctgaggaggagtgagctgaatagagatactgaaggtcaagctgaggtgaggtactgaaattctcaccagaccagagtgcggaaacctcattcatatatcattaacacacctggcatacggttgaaacaccagagagatcatgtcttagaattcaagagcactatccagagaaataattctcaaacagggcaattttgcctcccaggagagatgtggcaacgactggaggcactactggttgttacaactagagggacgctttcggtatctagtgggcagaggccacagatgctgttcaacatcttacaatgcacggagcagcctctccatccccaaaaagaaattatttagccctaaatgtcaagtgctacccaggttgagcactaaaaaagagttaactctaaacttgcccaagaaaaaacaagcactacctaacagggcctgcaaatgacacatgttttgaatcttgagtcccatcaagttagagaagcttggaaaacacctgaaaatttccaaagttctgccctaacaaagcataaaaaacaggcctatgagttcagccagttaatatggtattggagtaaaattcaatactttttagaattatcagaagtcagacatacaatgtatcatccaaaatgtccacaataaaaaaccttagacatgcaagaaagaaaatttaactcagggcaataaagaaagcagtcttcataataaaaaccaaacccctcaaatatataaataataaaagtaaatccaagtaggcacacacattggattttaagatttacagaaacaagtataaatgtacaatgggttagtatgttcaaagaaactgaggaaaaatatgagtaaagagatagagattttcagcaaaaaagtgtaaagttttttgtttgtttgtttgttttttgagaaagagtctcactctcacccaggctggagtacagtggtgtgatctcagctcactgcaacctctgcctcccgggttcaagcgattctcctgcctcagcctcctgagtaactgggattacaggcgtccgccaccacacccagctaaattttgtatttttagtagagatagggtttcaccatgttggccaggctagtctcaaactcctgacttcatgtgatctgcccgccttggcctcccaaagtgttgggattacatgccaccgtgcctggccagtgtaaagtatttttaaaaagagcccaataaacactctagagctgcaatactgaaatgagaaataaaggagaaaagaaaaatcactggctggtcttatcagcagtttaaaagcaacagagaagattgaataaaagtgaaaaagactgactgtcctataagacaatctcaaatagtttaatatatatgtaataggagtccaagaaaaacaagagtgtgagaataagtcaaaaaaaacttaagatataatggttaaatatttcctaaactttacaataataaaaagaatcaaatcaaagatccaagaagctcagcaaactccgagaagtataaataccaagtaaattatacctaggatcattatcaatcctctaaaaaatcagtatcaaagagaaaaaaaaatcaacccaaaaaaaaaaaaagagaaacattacaaacaaggtaataaagatacaaatgatggctaacaacttattagaaagaatgaaggccagttgacaatggaacacctttgaagggagaggggcagacaccaccagctatcacccagaattcaacatccagcaaccatgtgcttcaaaagaaaaaaaaaaatttgttcagattaaagaacaaaatgagagaattcatggccagcagacttctactataagaaatgttggccagtcgtggtggctcacgcctgtaatcccagcactttgggaggccaaggcaggcagatcacttgaggtcaggagttcaagaccagcctgggtaacatagcaaaaccccatctctaccaaaaatacaaaatttagccaggtgtggtgtcacatgcctataatcccagctactcgggaggctgagacaggagaatcacttgaacccgggaggcggaggttgcagtgagccgagattgtgccactgcactccagtctgggtgacagagtgagactctgtctcaaaaaaaaaaagaaaataaagaaatgctaatagatgttttacatgctgaaaaaaaattatatcaaatggaaacctggagctaaagggaaggaatgaagagcaccagaaatagtaattcagtgggtaatttaaaaactatttttttcttcttttaaattgtggaaagacaactgaataattaaagcataaatattgtatggcggtgaagatgaggggatattaaatacaaataaaccttaagcacaaatgaatccagtaagaaactttaaatacaagtgaatccagtaagtcaggatgcaaaaagttcatgattaaggagaaaaagagactaactctcataaccggagattttaacttctctcccttcttctctccctctcccccactgtctgtctgtctgtctgtctctctctctctcacacacacacacacacacacacacacacacacacacacacacacacacagagtatatttgtttttatccaaaggcatgattatctaaatagctatcctaaggaatcagccaaaaattactgcaacttaacgcactttagcaaggtttcaggaaacaaagcaaaaatacaaaaatcaattgtatttctatatactaacaacaaacggtaagtgaaaatttaaaatacgatttatggccgggcacagtggctcactcctgtaatcccagcactttgggaggccaaggtgggtggatcacctgaggtcaggagttcgagacctgcctggccaacatggtaaaatcccgtctctactaaaaatacaaaaattagtcgggtgcagtggcatgcatctgtaatcccagctactcaggaggctgaggcagggtaattgcttgagcccaggaggcggaggttgcagtgagccaagatcgtgccactgcactccagcttgggcaacagagcgagagtctgtctcaaaaaataaataaaataaataaataaaataccatttataacagcacaaatgctactttgaattatggcattcttttttaaatgctaacaaatataaaaatataaaaatataaaatataaaaatataacaaatgatctttaagacctctatcctaataattacaaggagagttaaagatctagggcttggcgtgagtggctcatgcctgtaatcccaacactttggcaggctgaaacaggagaatcaattgagctcaggaagatcatcctgggcaacatactgagactccatctccacttaaaaaaaaaaaaaaaagaaaaagaaatgtataaagatgtagataactgaggaataggtaaatacactattttcttagactggaaatctaaataatgttaagatgcccactcttaacattaatagtcaggtggatagaattgccctgttggagaattacttctccaacagggcaattacttcatctggaattacttcatctggaattctaagaccatgtcttagaattcaagatgcataacccaacagtttcctgtaaaacttgaaaagctgattctaaagtcaatatgaaaatgcaagagacttagaatagtcaaaacaatcataaaagaaaaacaggttgggtaactttcactatttgatttataaagctatagtaattaagataatttgctatgaagaaagaatagattctatccatctgactactaaagtaaaacaaagaaaatatagatcaacaaaacagaatagaggatccagaaaaagattcacacataaatggccatctaatctacattttctccaacttaattcaatggggaaagagtagtcttcaacaagttgttatcaggaaactggccctgggaagcgaatgtgcttctcttaagattttacagcttagaaaatgacagcactgagatgtgaactcaggtctgactgctctgagtccatgattgctctcagagtccacactcaatctctacccttgccaatctgccactagaggacttcatggagtcttctacaaagtgcctggacacctgactcaacacccgggctctcctgcatatgagattcccagaccagatggtaggacactcgggctgatgaacagctaccatgcttgaggtttatacctacaagtccgaaggagttattcaccaatgagggggattaaacccgcaacccatatgctatctctgtgaactggaaggtcttagttataaagcataaaattaagctgaacacatatttgaggcctattagtatcacataggagcttttaaaatttccctaaagcaattaaatcagaatgtttaggggaagagtccagacaccagtggtattttaaagatttcccctcatgaatacaacagagagcagtttgaggaaccactgagctaaagcattttcttccagtttgcacccacaccccagtgaagcaaatacaattatcagatgatgggacgcatctgacactcctaaatctccagcagcagaaatttcctcttggaaaaatccaaacaaaacaagtcctccctccttaacttgctttcttagctcaaactccaagctatggaaagttaacttggctcctcttaagctattccctagcaaactagaagactgacaaattgtcccttgatgagattaatgtctcacaaaatgcccaggtacaattcaagttcacatcagaagtaaaaccaaaaactgtgggggagaaaagtttttgaaacaaaaattttaacgtattatggacaatgtaagaagcactactgggtcattctaattttgtcagaaacttagaaaataacattagaagaggaagtccaaccaaagtatcacatgtgtccagggagataacttccacacacaccacacagtttcactttgacaacactgtcaagaggctctctacgaatcttcagaaaggaaaccgatctacagactaatagacaaaagattagtttgagccatatgaaattgctagttttgtaaaaaggcccaaaggagttgaatatatgtaatttcttttttttaaagaagagtcttgttctgtcacccacgctggagtgcggtggcacggatctcagctcactgcaacctccacctcctgggttcaagcaattcttgtgcctcagcctcccaagtagatgggatcacaggcgtgcaccaccatgccaggctaatttttgtatttttagtagagatggggtttcaccatgttggtcaggctggtctcgaactcctggcctcaagtgatccacccaccttggcctcccatagtgttgggattacaggtgtgagccactgcacccggccctgaatatctgtaatttcatactattcagtctaaatataaagcaatatacagtctacagtgaaataaaaatagctttaaataaaaacaaaagttctgttttaaaactaagaccacaacactgtatggctcagttgctgacaaaatttgctatcaattgtctgtccacatccactgagaaaacccagagggagacggggtgggaagactgggatgcagccagagagctacaggtggctgcaatcttctcaccatcagcgcatgacggtgcatttattttttttacttcaggttctacttattgcatagggcggcagacatgacttgggaagggtgcacaagcccagcctctctgtgcattatgggagggcaccttccacttcctactcagtctgtggtagaggaggctgtctgctgctctgaccactgacctaaaaatatacctgccctgcagcaatgccaagaaaagagaaggaaaagatcaaggccaggcgcagtggctcacacctgtaatcccagcactttgagaggtcaatgtaggcgcattacctgaggtttggagttcgcgaccagcctggccaacatggtgaaatgccgtctctactaaaaatacaaaaatgcaccaccatgcctgtaatcccagctacttgggaagctgaggcatgggaatcacttgaacccgggaggcggaggttgcagtgaactaagatcatgccactgtgctctagcctgggcgacagagcaagactctgtcttgaaaaaaaaaaaaaagccaggagtggtggctcacacctgtaatcctggtactttgggaggccaaggcaggaggatcccttgagcccaggagttcgagaccagcctgggcaacatagggagaccctgtctctttaaagaaaaaaaaaggaaatggtcaagaggagagggttctcaaatgaaaagattaaaagaaacaggaattcttcccccagaaagatgaagagtacctgataatatgaactctggatggagcatccaagagaatatatacatgtattcctggagtatccatattccctgcatacagggaatatgcatttccccccaagttacagaattctaaaaagagaaccacacagtatcacataaatggttaaacaatacacttagggtaactacaaatatttctcaacacagaaatctatagagagcacccctctgagatacactacatacatatattccatatattcttctagggcagatctgtaataaatgataaaggaaaactagaaagtctgcagggactcaacacaccttagaaggtggaagatgaaggacagacagatactttacctcaaactatccttcagagtaactctaaagaaagtgaagacgagcagttttatccagaataaaaagtttccccaaactttctcaattctgcaaaaaagtctgcaaacagcagagaggagcaccagcaagcaggctcaggtactgctgtagctttacctggcattcaggacaagccaacccaacatcaaaatccacaactcagaagccaacccactgcaggaaccaccacggttcttcaaattagatacaaagtcaagaaatcttgagctaattaggccacagatcttaaggaaaagtctctatgcctaatgtatttgataatacaaaagctgggatgacaagcccatcctgattaatgaaactgtcctccattccatcgtaggtctagcattcagatgtttagcattcaggctcagatctatcctggccctaagtcaaggtaggcaagggcaaatgggagatccagtctcactggtggctggggctgaagatcttcagctatccttaatccaggctcagtttgactaaagggaccctcttcctccaacatggagccaactccccaactcatgtgctctaagctatagaagtaaccccttgagacttgaagatggacacatcccctgcttctgtgtcccagatagctaaaaagtaaaaacaggagataaggcactgtccccactgcagaggttatacgaacccatgctgggaatatgacttgtgactgacgacattctaacatgagcaagtacaatgttcagcacactattgccatgaggagcccatattcttaatgccaatctgttgacctcacttaaaatacagcctgtgctgcacagtctttttatttggtaaaagttgtaagaaataacacagagttccgaggaacctgaacaaaccaccatgaaccatttcaacagaccacccttggagccatcaatccaaattaaagctagtcatgattcataaaaacatctcatttagttctcaagttaaacagacaaattattaaagaataagtgggaatgtaaaatggtgtggccactgtgaaaaacagtatgatggttcctcaaaaaattaaacagaattaccacataacccagcaactccatctctaaataaatatatactcaaaagtattaaaagcaaggactcggccgggtacagtggctcacgcctgtaatcccagcactttgggaggccaaggtgagcagatcgcgaggtcagtagtttgagatcagtctggccaacatggtgaaaccctgtctctattaaaaatacaaaaattagcctggcgtggtggcaggtgcctgtagtcccagctactcaggaggctgaggcaggagaatcacttgaacccaggaggcagaggttgtagtgagctgagatcatgccactgcactcctgactgggtgacagagcaagactccatctcaaaaataaaaataaatgaaaactaaatgcaaggactcaaagagataattgtacattcgtgttcatagcagcattgttcacaatagctaaaaggcagaaataacccaaatgtccggtggcagatgaatggataaacaaaatgaggcatatccaaatagtggaatattattcactctttcaaaggaattaaaatctggcatacaatacaacacagataatccctgaagaccttatgctacatgaagtgagccagacagaaaataacaaatactgtatgattctacttctatgaaatacctagagtcatcaaattcatagagctggaaagcagaaggctgacaactgtggagaggggagagtggacaccagtgcctaatgggtacagagtttccacctgggaagatgaacaaattctgtcgatggatggtggggttgggaggcacaatgatgtgaatgtacttaatgcaaacgaactactactgtacacttaaaaagagttaaaatggtaaattttatgttatgcatattttattacaataagaagaaaaattaatgatgaaaagcctaaagtaattttaccaaagctgtgaaaaagtaaataaatgacgagtcattttcagacatcctgcaagatcattcaataccaaatgtcgacgacgggctcggcagtcattccatttgcaacagccaacctgatttctgccagaccgggaatcaggatatgggggcctcagtggaaactgccagtgtcgcagagggacctttcagagtcctgctgcagagccagcctctgccccaaggaagcagcccacgtgtgaggaggaagtgtcttatttcttcacctgggcatgtttccacatacaaggcaggacatgaggatattcgtctttcccacgtttctgggatttcaggttaagtcttatggtttaacccaagcaatttttgacttcataaagagacaatacttctaagataatcaagctgacaaattaatacctttgggagatgtttacatgcaggcaagcaagtctgccgagttagatcagatttcccaaaggctattttccaaagcgttagtggaaaagaggaagaaaaacaggtgaacagtatctcacttgtacaaagagctgtgttttactgaaccactacctcaaaccggacttcatgtagggtgtttttaaagtttgccaagtggagtgttagtgaaaatttttatgaatttattagaagtatgatcttgaaagacaaaaatctagctagtttatagaaaaacctgagtattcttctcctaaatggtagaagagagtacaggagaataacacagatgatgatgatgctgctgctgctgatgatgatggtggtggtggtggtggtggtggtggtgatgatgatgaagaccccttgactagtgtgtacaagccttgttatcattttcatgtcacacatgaggaatccgggcatacctgttatactgtaccatagacactaagacacgaggcctccaggattcacagaattataagattgattcccccatgtcaaaggaagacttggggaggacaccttacggacactctggataagtgacaacgaggtcaaagaagaatactttaaatttaaatgggctgggtgcggtggctcccacctgtaatcccagcactttgggaggccgagacgggcagatcacaaggtcaggagttcaagaccagcctggccaacatggtgacaccacgtctctactaaaaatacaaaaattagctgggtgtggtggcccatgtccataatcccagctactcggcaggctgaggcagaagaatcgcttgaacccgggaggtggaggttgcagtgagcagaggttgcaccactacactccagcctgggcgacagagcaagacttcatctcaaaaaaaaaaaaaaatttaaatggcttaaaaaaacggcccaggacaaagagatatccaggactgatttaatgacaagttctttagctcttgacactagcatctctatggcaacttctcagcaaagcaaccagaaatcccactccttctataacagttaagaccacagcaaactatggtattatttatggcatatctcaatacaaaagcacaaataaaataagaaaatatcaaatcaggtcttatcattattactgccctaatgggaaagaaaatacagtcagcctttcctgtgcatgggtttggcatccctggactcaaccaacctggggttgaaaatatttgggggaaacaaaataggtgattgtgtctgtactgaacacacacagatttttttcttgtcactattccctaaacagttatttgtttatagtacctaatacaatgtatatttacattatacaatgtacaattatataatgtacaatttacaatgtgcaattaaataatgtacactttacaatgtacattatataactgtacacaatgtacattgtatattgtacattatataatgtatatttacattgtattaggtattataagtaaaccaagatgatttaaagtacatgggagtgcacccataaaaaaaaaaaaaatcatgtcctttgcagccacgtggatgcagctggagaccattatcctaagcgaattaacgcaggaacagaaaaccaaataccagatgttctcacttataagtgggaggtaatcattgggtacagatggacataaagatgagaacaaagacactgaagactactagagttgggagagagggaatgcggcaagggctgaaaaactacctatcaggtaccacactcatggcctgggggatgggatcatccataacccaaacctcagcatcacacaatacacccatggaaaaaacttgcacctctacccctgaatctaaaataaaagatgaaattatttaaaataaataaataaataaaatgccatatatgggagggtgtgaataagttatatacaaatactatgccactttatatcaaggacttaagcatcctccaatttttttgtatcctcaagaggtcctgtaaccaatcccccacgaataccaagggacaactgtttaatgtaaaaacttactttgaatgaaaaccaacataaaatagaaacactataagttctctccaaaattgtgaaaaacaatcaacaattcaaagtgttatcccaaacatccaactattttcttaaataccattaaaaacaaccacaactagatttagaatataaagaaagcctgtatccgacgtggattccatttacatttttcttcagttaagaaaattatatggaatatgactaaatggttcatttaaaaaatataagaattccctttctcaaatatattcttttctcctagatttaatttcatagatccaatttcactgaagttcacttctgaatacaactgtgatgtaagtgaaggttttaatgaacaacaacaaaaatttccataaatacaactatgagattgaggcaaagaaacactgaaaaccaatttgatatttttaattagatttcattataaatttagtattctgcaacagcctgttatcaaaggcagccatgccctgacagcagtagaaaactttcattatacactggaaaattttgcataaagaaaaaaaacattggcctgatgcaaatagcaagcttctctagtaaggtgtaaatgattctatttacagaagttttcttcgtttttctttttttagagacagggtcttgctctgtcacccaggctggagtgcagtggctatttatgcagtatttaatttacataaaacttcctcagaatgcttctgatgcttcaggtgaggtacatgtttaatgctgaatgtcacttaccttccgataaatcatatggcacatggctactcgtaacctcatcccagcacactgaacgtgataaaaatataagtgatgcagtatagccaaaatgagcgtgcaaaaagtcagcaccgtggcataggcgtacgctgtgttcaaagccacagaatccatgggatcataattttcaaaataattaataatttttcccaaaaatatgggctggattactttggcactttcctaaaagaagaaaaagaaaagcctttaattagacatacagaccacaccattttttctttttactttctcttttttcagatattgcttgctctgtcacccatgctggagtatagtggcacaatcccagctcacagcagcctcgaactccctaactcaagcaatcctcacacctcagcctcccaagtagctgggactacaagtgcacaccatcatgtagagctaaattttttttttttggtcaagacagggtctcactatgttgcccaggctggtcccgaactcctagcctcaagtgatcctcccacctcagcctcccaaagtgctaggattacagatgtgagccacggcacctaggctcgttttttcttaacacaagttttatattttcaaagtgcaacattcatcactcatctaaaagaaaagcagaactgttttcttctttaagacaagccgataggagttttaacctgaaatcaaaattctaatttcaaagtcaataaagttttagtacattgtgcttggtacactgtgggtgctctgtattacaaacagggctttaaagcacacttggcaaactaccaaattaagtcttggcctaaggtgaataaggaaaaaaatggcccaagaggagtaaggaatttgcttacaaacagacaccccagctctcaccccacttcctctgtacccttgacatcccagcccacaggctcgtctatgggaggccagcactcttgccaccttcttcacagttaagagcctttgtgaatggagatattggcacaaacccagatcagaaaatcaaactctccaatttttcccaatccaaactccaagagtcggtagatctaacaccaccaagtccagcttcagttggagtggggaaaagaaccagacttgggaggattccaggctcttggacccacaggacattgcttcagtatgtttctgccccctacaagcccggatgtgcccagaagaactgccactttggctcaggtagtgtggagtcaaaaattaaacacagcagaaattgagctcaaagggaatgtcatcagtggctctctttatcagccatattttgaaggtcctggttttgaagcaatattaataatcatcttttccccaaggcaaaattaaaatcccacaccaatgagctgggaagcatgcgggcttaccttctgaacaagatgtagggaatgcaattttaacctccaagactaaaggcaaagaaacagcagaacgcagcttgagccacggtttgaggtaagcaaaggagctttcctttaccctccctgccaaatgagcacttcacccggcaacctacttcctccctctcgaacccgttgtaagggacccttttcccccaacaaagaaaaccaaacactcattgcaaatccaggtcaccaaaagtaaacatgtaggccctcgacatcatttcctcctgacttctcaaaagacaaaatgcaaaatgtttgaaaatctttcaagaccttaaccttgaaaaacaacttttccttttaagcaatctctccttcttaacaaagacataataaacacctgacaggtttgccattgatagctgttttctgtccatctgaagtgagagaagaacaatcagtaaaaaacaaaaacaaaattaacacacactttcatcccaaacaactagcacgggatcaggatatttacagaagacattcccatccctcagatgggtcatgatattaaatcccaacaagcctgtctcggcatgtgaacgcgcgcgtgcgcgcacacacacacacacacactctctctcacacacttcaccaactgcactgccttccatgaggtcatggaagttttcccctatgatacagaaatcagaaaataccatttagttgaagaattatgaataagatgatcagatatcaagaatgcagaggctcaccattacatttccagcatggccaatcattcaaaaggcactaagagtttatggaagagcccccagtacaatgggtcataacacggactgtttagagtttactgagatgaaaatctggacgtttacatcaagaagcaagacggccaaactgtacacatgggcagccctggctcaggagtgccaagggcaaccagggccgcagcagacacacctgggctatcagccagacgctcagtgctctttgcctttctaaatgttcctgaaacttctcacagtccctgggagtcactgttacctgttacacgcttctccatttcagccgtaggtgagtatgattcaaacggcaagagggatgacccccagaggaaataacagatgcaataaacccagcgaaagagaatgcaaaaggcaggtaggtcacgactacctaattgtccagatttccctgccgagagacagcatttaataatccagtcaagcaaatgggctcattggtgagtaatgctggtttttggtccatgcttttccacggacctctccatcttaaccttcaactaataagaaacgaaacaactgggaaaatactcattatcaaaattacaactaaccaaatttaaactttctaaatatcagtaccaaggtcaaaagtaactcacataaattctccaccttagagaccaaccaatctatgacctggtgaagagtctttccacaaacaagctaagaatagtccttactccttcacaagaattctcctcgactgtgaaaccatggaggtttttgagagtccagtaggatacttgaatgttccatacttcaggttctactggagtcccagagtacttgaaggcagatacttctcaatggagtatttggtactcagcctcctgacattcgagccccatcccttgctttcttggagtgacacattacatgtctaggcccagcgggcacgcggcctccatgctcctgctcccccacgcacttcagatattccttgcccaactgcaccataccagattgcatgggaaggaaagaaaacacaggaaatagaaacaagctaccaaagaagatgtttgagtgaaaaatacaagcagaaaagagtgagctgtggaaaaatgagtaagcagtttgttttagaaatggggaaatacagccaggcgcggtggctcccacctgtaatcccagcactttgggaggccgaggtgggcagatcacttgaggtcaggaggtcaagaccagcctggccaacatggtgaaaccccatctctactaaaaacacaaaaattagctgggtatggtggctcgcacctgtaatcccagctactggggaggctgaggcacaagaatcacttgaacccaggaggtaaggctgcagtgagccaagatcgcgccactgcactccagcctggagaacagcacaagactccatctcagaaaaaaaaaaaaaaaaaaaaagaaatgggggaacaggggacaaaactagggttgagaaagatccagagataaggaagaaaaaaggtgaatctggggaaataataaccattaagactccagatatacctgaagtcctctctgaatcagtgcagtcctgactgcatgttagaatcacccaggagacttacacgctcactgatgctcaggacccatcccccacatttagggccaattgatcagggtagggcctgagttccccatccccggaagattctggagtgtagaaaccaatgcctgtacacatcactattctcctctcctgcactctctgtgtctgagtctggaggggctggagacccgctgtgaagagcttttttgagatggagtttcactcttgttgcgcaggctggagtgcagtggtgcaatctcagctcaccgcaacctccacctcccagattcaagcaattctcctgccttggcctcctgagtagctgggactacaggcacatgccaccacgaccaactaatttttgtatttttttagtagagacaggatttcaccatattgtccaggctggtctcgaactcctgacctcgtgatctgcctgccttggcctcccaaagtgctgggattacaggcgtgagccactgtgcctgaccctgaagaacttttaagaccacaaagggcttttaatcagaactgctgccaaatgttaggcttccaagaaaatcccttaggaaaaaaggatgctgagatttcagtgatgaaactaagatcttccattctgcacagcagggaaaattaaatgttcagtaaagactgtacctaccaaacaaaaggatgaatcataatttgtttttttaactttaaacaaaatagtttaactagtttatttgactgtaaaaaaaaatagtttgaaaagatagtccctgcacattattatctaccctaaggacaatgtaaactgcaaaaaaaaaaaaaatttaaattatttttagaaatcatattatgggtaatagtgttgatactgtaagataaaataaatgaataagtatgttgatatcaagagctgggattaggctagggagaaaaaagaacagatgaagggagaaaagagatacagatgtaagagtaaagagattaagtcaaaacactggtgtcctgaatctgatttggaaatacccacataaattcatgatatgtttatctttaaatataaacataaaaggagttaaagctgctaggaaaaatggttgattccacagctggggcaaaaactgttcagggagcctaaaacatctgtcataccagaaaatgaggaagttgcaaagactaatagtatacattcaaaagactcagggcccaacttcgatagactcccactagccaaagacagccaaagcgtggcacagggatgataactgtaatgaacagcacatcagaactgtttaaatccatgagctcacaatcatactcatcaaaatatacagaacaagcaataacaaaaaatccattaactccacaggaaaatgctggagaatcactcattattttgaaaatcggttttaaaaaaaaataacaaaattaatcatttctcctgcctttcctataggtgtactgtaactcagagtatcaaagagttgataatggcaaagtttctctttatgcaaatatttcagctaataaatgaggaactggaatatcaccactttgcaaactcctaacaaattaatgcatcttaagcaatgatcatgaatggctccaaataccacacacacataaccagacctaagcgaggtatctcgaagtggcaggtggtacacaccctcacctacaaagtactcttgccaaagggaggaggggggaaaataaaacctgaatcacatcaagcttctagatctaactactaacttctggtaccagatggacatgttaaatgatacagcatgcaaggatgtagagggtcacaagaggggaggagggatatgcaatgagcccaatctagaccctgggaatccgtgcagggcaaacaacacggtttcttcaattagaaagtacacacgcggctgggcgcgatgtaatctcagcactttgagaggctgaggcaggtggaccacttgaggtcaggagttcgagaccagcctggccaacatggtgaaaccccatctctactaaaaatacaaaattacccgggcatggtggcagatgcctataatcccagctactcaggaggctgaggcaggagaatcacttgaacccaggaggcagaggttgcagtgaaccaagatcatgccactgcactccagcctgggcaagagcaaaactccatctcaaaacacacacacacacacacacacacacacacacacacatcttcagagggggcagtgagcagggcttcataaaaatcaagagtggtcatgagttgatagttactgaagctggcttaggggtagagagaggcttagtattctattatattttatatttttgaaatgatctttaaaaacctaagaaagatcccagcattttgggaggccgaggcagacgaatcacttgaggtcaggagttcgagaccaggctggccaacatggtaaaaccctgtctctactaaaaatacaaaaattagctacatgtggtggtataagcttgcaatcccagctattcgggaggctgaggcagaagaatggcttgaaccaaggagacagaggttgcagtgagccaagatcacaccactgcactctaacctgggtgacagagtgagactctggctcaaaaaacaaaacaaccaaagaaagaaaataccacatgaggcttggccttggccctcatgtcaggcagctgaacaagaaatgtagaattgaagttattaaaaaccacctcattggccaggcacgatggctcatgcctgtaatcccagcactctgggaggccaaggtgggtgaatcacaaggtcaagagatcgagaccatcctggccaacatggtgaaaccccatctctactaaaaatacaaaaaaattagctgggtgtggtggcgcacacctgtagtcccagctactcaggaggcagaggcagcagaatcacttgaacctgggaggcagaggttgcagtgagccgagatcgtgccactgcactccagcctggtgacagaatgagactccatctcaggaaaaaaaaaaaaatacacatctcatttctcaaagaaacatttagataatcttcaactatctaaaatacaaagaccaacaagcagcatagatacaaatggagaagctgcctgtgtcctggtttggcccacacagaggattcccaagctcctccttcctcctgccccccctgcaggctctaagtgggtggatacttgctcagtctccagtccccatcacagtctccatggaggtgcacataggggacagatgtgctggaaatttgcgggctgttctgttctaattagcatttgcctggaagagcaccatgttcaccattagactagtacttgtttctctgggcattataatcattcctcaactctgacaatcgttcctaatctcacttgcattactttgaaattccaacctcaaagactccccgcaaactggtgtcaccatctctcttcctgctggtgccatcattagtacccagggaaggccctgcttgccttcagcttagttaagagtatatggctagggagttatggatccactgcacagttgttctgtaaccagaggaattaacccatctgtgcctagcattccattattggaacactaagcttgtgggagtttatattctactgttcaacctcatcgccaaggtctgatctttcacacacaaaaaaaattggcaacctccggcataagtgggttaaaaaaggcctgaaagtcatcacagaagctttttactaaatgctaggttaagtttagagcttccactatccaaaatacgaagatccacaagcagcacagacacaagaccaaaaaatgaaaagcatcttcattaaatcaactgtgaaactaacatttgttctaactccataatttttttttttgagacagagtcttgctctgtcacccaggctgaagtgcagtggcgtgatctcagctcactgcaacctccacctcccaggttcaagcaattctcctgcctcagcctcctgagtagctgggattacaggcgcccaccaccatgcccagctaatttttatatttttaatagagatggggtttcaccaggttggtcaggctggtctcgaactcctgaccttgtgatccgcccgccttggcctcccaaagtgctgggattacaggcgtgagccactgcgcctggcctaattttcttttttagagacaaggtcttgctctgtcacccatgctggagtgcagtggtgcaatcatagctcactaaagctgggaactcctgggctcaaataatcatcccttggcatcccaaaatgctgggattataggcataagccaccatgcctggccaataaatagctttaatgattgaaaacccaaaacaacacctgaaatgcttttgagatgttacactcactaccttcatcttaagaaattatttctctccaacttctccaaaacagccaagtgtcaataggcaaggctgggaaaacaatagtatttatactagaattcaggctgttttcactgctagaaggaaaagaaaaaaaaaaatccaaggattactttgagttgaactgggaagagctttagctccctgaacttcactgcatcggaactaaaagttctaccagttattatgttaaagacacaaggttaaaatgagcatcatccactagtcaccatgatcctctaaagaataactgactactgtctaattttataccataaaccaccaagatattggtgtaaacacaggaccaacaagtgctctcttgtgaaaagcccaggctccactttatatgagaggtgcctgccgccagcactgtgtgggtccatcttaacaccttagcctgccgccctaatacctggggcccaccttgctagtgggagggttcagataccaggacagaagagctgtccccatactagtgactcatctggggtcttcatccttgccaagcaaactgcacacccacttcacgattcaggccaaaggcttctgaaactgcagagatatcattgctatgcaagaaacccagagcctttgataagtaaaaacagggaacttgacatccgcccagaccatcagtcaatgtcgtgaccatgcaagaccacaagcttccccctcgtccatccgaggaggagacaactgggaatggtgtcttaacagcgtggatgttgatgaacttgggtcagcagggctgcacgcctcacacatgtggaggatggtactcagtgggagacaggtttctaaagggttcttggtcagccaggcacagtggctcacacctgtaatcccattaatttgggagggcgaggtgggccgatggcttgagctcaggagttctagaccggcccggacaacatggtaaaacctcatctctactaaaaatacaaaaaataagccaggcatggtgcatgcctatagtcacagctactcaggaggctgaggtgggaggattgcttgagcccagggagatggaggttgcagtgagctgagatcacaccactgcactccagcctgagtgacagagtgagaccccacctcagacgaaaacataaaaaaaaaaaaagagttcgtggtcaacctgaatgtaccttggtgctctgacctgcccagcaccccagccactctctagcatgtcacctgactttccggcaccaggacacctaggaacctagggtaatttataatccccaatctgatttcccacagccatgccccactgttccagggagctcttagcatctgacttatccctaggccaagttcaagaagcatgtgctggatactctgaagacagagttctcaagacacctttacgacagtctggagatggttaggtccctaagtcagcgctcctgagactgaatctgggctctgtcatttacactttgtgtggccctaggcacattatataactacatggcacccagtgtcctcttcccaaaagtagggttaaaagaatgccttctgactgagcatggtgattcctgcctataatcccagcactttgagaggccaaggtgggaggatcatttgagcccaggagttcaagaccaacctgggcaacatagtgaaacaaaaatacaaaaattaaccaggcatggtggcgtgcacctgtggtcctagctacttgggaggactgcttgagcccagtaggccaaagctgcagtgagccaagatagcaccactgcactccagcctggcaacagagtgagaccctatctcaaaaaacaaaataaaataaaataacatgaaagaaagaaagaaagaaagaaagaaagaaagaaagaaagaaagaaagaaagaaagaaagaaagaaagaaagaaatcatagcagttcctggtacatagtatttttcaagtactcactgtcagtattattacaactattgctactatcactgctgctgctactactactactgagtaccaaccactactaatcctgctgctgcttctactagcactgctgctgctaagcagtactgagcatgagcccccatatttgccaggtcctccactccctacttttctgccatgactgcccaataaccaccccgctaaaagaccagctctccaccaactgtacccatattaaagctcccctcgatccgggccccttcccacatgcccaccagcagtaaagattaccatgctccttgcaccagagtggggcctgtcctcaagtctcaggagaaattcacgcttctacagcctctacttctgtgcctgcttctcccaaaagcttacccaaatctcactgtagtccagtcaccatctgtgggttagagaccccaccccaagtggctggcagcccatgacagcatggacagccctgagcatgacaagctcagttccttctaaatcatcctgttttcaatttcataagcagctggtgacaaagggaaactagagaaatggaagtagctgagggaggcatgcctcgaaacctatgtgaggccattgattcccactacacctaaccagacacctggcatgagccttagacacttacagaggctccatggctaccagacaacttctctgaggttgcacagccaaactgggccaggaaatcctgcacacactggccacattgacaccgacttgtcattctatttctttccaactgaaactgatcggggccatgtggaaacactatcgctgggacaccccagcacaggttgaagaggggctgggagaacctgaggggctcctagccctcttccaccctcaagtcagttccaccggttattctgcatgtccaccccatctgccacaaagccacagtagcatgcaggcagggcgggtaccctctcaaaggtggcattcaccatctggcaccctggccaaaacacctttgtcaccaatgagaccattcatctcccaggaccgtccagtcccctgttgtctgacagattcctctggtgtagggcagagctcacctacctgcctcccactgcccaccgtgccctccacaacaaaaagcatgttcaacaggagcaaacccccccacatacaaaccaaccccctccccccacccacctcattcccaacaaaatgcaccgtgacaactccccatcctgcatttaaagccacccttttgtaacaacagcaacatccacccctctaactttaatggaccactgacatccctaaggtagcacagaggacacaagtcacccagcaggaccctctgcatctcctctagcaggccaaagaccagaacggacaagctacctggcagtgtgcctaggcagaacactgtctttctgcagatctcaagagaggcccttcggggtaacagaggttattgcccttctggctgtctttgatttttcatggaatgtccatttatacattctctgcagggccaggcaccaagactctaccttccaaccagcaatccactccgacaacaaggaagacacaccggatgggtgtgatgaatccccttgggtgcacagtcctcggaccttcttcccagaggggattttggctcccagcacctgggcccactgggagggggtagctcttgggtgcttcagccagctccagcctctggggcaccaccgccagcccaggtgcaaggccctcagctctgtttccccgagaggggagaggtgacaatacctctccagaagagcaattatcagatttggcttggtgaacaattatttgttgagcacctgtaaaatgtcttacattattctgggctccgatccaaaatcacttcctctaaaccacagggcacgcactcctcaaggctgtaggatcctcttttgaccaggagtgactcttagcatttaaaacatttaccgagcaccaacattgtcctaccatagaataaaatactcttcttccatgacactgcattttaattggttacaagaaaaacaataatgaccttgaacttcagtcacttaagtattcacctggataaatacgctcactgaactaactacctaatacttcctagacatgtttaatccttagaccttaaaataccttcaaaccccatctggccacttctcccttctgttcccccatccattacagcaccagtcaatggcgagcacatttactctatgtgtcctgaaaaacaattcatggtatgtaaaagcttttacctcaattaacgtaaaaattcccaaaactaaataagatttccagtaacactttatgattgctcttgttaaagaaggcttctgtgcgtcattctcagctcttaaaacttctttatcccagaacctacaatgaggaaaaagcttcgtaaataagagtgaaccctgccacaatataaaacaggggagatggcagagtgacaggtatgcatttaagacagggcattttgtgacgatttcataaatgctactaattgctcccagggctcctgaaggttatgtgtggtacagaatctggagcatcagaaaaacaggccttgaggggaagtctggggaaacaagttactgccaagctttactggattgaagccccatcagtagcacagataagccagacaacctcctccaaccacaacacttccacctagagggacagacctcaggcatctcgggcctttggtgctggctcccctgacctctacggaggcacaggcaacaggagtttcccccaggccaccatggtaggctgagcctaggggcagcctgaggaaggtgacacatattcaccttaagggtaaacggaggctccagacaggacccaggaaggcaaaacccactccccacacacagacacccacgcttccttaatgcccactttactgcctccgacttacccttgcaactcctctccaaggtgctgtgagcggtcttctggcagcactgaatacatatcatcttcctctaatctccgtttatggccaattttaaacaagggattgagccacctgttaacaagagaaaagagacatatatccagaattacacatccgtgtttaagtagactcctacctccatgggttttgcttaaacttacctttaaaatacatacagctatatatagacagacagatatgaatatatagagctagagagagaaaagttaacatgtgcacacacacacacacacacacagtccctagctctatccacagacaggccccagaagcaatgacacaccagtagctgagagcatgctggtgcccagatcttggtttccaaaaccattattatctaaaaggaaccagagcttcctgaagaaatagctgattcaaaggctggggcagaaaaagatggcccatgagataccatacgataaggaaacattcaaggaatcaagaggatgggcccaaagaacagaggacccagcttgacggggtcccactagacaagtctgtgataatggaagcatccaaataaatcatgacagcaatgaattctaacccactgaataacaaaagaatccacgaatccttactgagacataaatggggtaagaaggaaaaactctcagataaagaatgatgaggttagaaaacattttcaatgggagctaaaaccagtcagtgaaggtttgatgggacatttacataatccaaaattatctaggtacaaattatttattagttacgaaaggacaaaatagtaatcttgcagaggacagaaagaacttattcaaatattttgagattctttttactaaaaaaaaagaaaaatcaaaatggtcatccattaggaatcacttaaatgatattaacattattaatcattaaatgataataattaacatcattaatcattaaatgataataattaacatgcaccaggcatagtggctcacacctgtaactccagagctttgggaggctgaggagggagaatggcttgagcccaggagtttgagaccagcctacacaacatagtgagatgcccacttctactaaaaacttataaagaaaaaggctgggcagtggctcatgcctgtaaccccagcactttaggtggctgaggtaggcggatcacttgaggccagaagctcgagaccagcccggcaaaaccccatctctagtaagaaaatataaaaattagcgaggtgtgatgacacatgcctgtaatcccagctactcgggaagctgcggcacaagaatcacttgagcctgggaggcagaggttgcagtgagctgagatcgatgccactgcactccagtctgggcaacagagtgagactatctcaaaacaataaaaaatataaataataattaaaatttagccagatgtactggtgtaagcctgtgatcccagctattccagaggctgaggtgggaggatggactgagctcaggaggtcaaggctgcagtgagctgtgatcgccactgcacaccagcctgagcagaacagcaaggctttgtctaaaaaaaaaaaaaagaagaagaaacatatttgtgccctataaggaaacctctaataactttgatagatgcaattactcaattacacaaacttctttcatcttggctgtcttatctggccatgtgtcacctttaataggcatgttttattttaacatggggattgtctaatctaggaagcccttcccatggggaacccactgcctggtggcttctgcctgcagtgaaatggtgggctttcaatgccccgtaagattggagcacacactgcaggggtatccaagttatgttcaggattccggaaacctcctgctgatccaaactagcaattctaattaacccaatggcaagaagaactcatcaactcacctctttctcctcacctcctccaaaatgtgtccagaagactgtaacctaaccagtccagcttcaacttaggtgggtttcccagacatgcctgagatgacctctgcatgcccgagacctcccttccagcagaacctcatacagtatatttcagcaaggacttctaagtaaaattcactggtgtctttttggactaaagaggtttttttaatcagggaataaaactggctccaggaagttaaaaaattaaggaaagtgagaatggtaactctgttccacaggctgaacagttaactgcataacatttagaaatattaacaaggagggatgccactgttgagttaaagtatctgcaatcagaagagacccaaagcttctattagaggatgacacaaatcagtaaggacttaacaaggaccctcctactctctctcattgcccagatctcaaaaagctgggctgaaaagatgtgggtaccagcaagagctaaaggcttttgcctgatgacaaaagtcaactttgacaagagactaaattatctttgaccatctatgtaaggactttatacatggaaatctaagtcagttggctccttaataccaatgtgtccctgagggggtctagtcaacaattccagaccactgccaaatgagccattcctccacccagttctgccccagtagcccttctctcctcagacttagtctcttctcccccttatctcccacaatacttagtacagcagcatcgcttccctcctaactgtcctactaggagtacaatgctttcagggcaatgactactgccatattatttggaatccccattatgcctggtatgtgatagatactcaataaacagttatggaaagaatgaatgattgtattattgaataagacagatgggtagagtaccttgagcaatgatctagggtaaaattcaatacaaactcaatatagcatagtcgtgctcaatgcccaacacaggaagccatcagcttcagcaatacagagacattctccaccccaggatcacaacccccagcatcatttccagcaagcaggagtcttagacaagggttagtagagagttttgttatttattgttggtggtggtggcatttagtttttgttgttttttcccccaaggatttgagaagttctgaatactggtttctttttttttttttttttttttttttgagatggagtctcactctgttgcccaggctggatggagtacagtggagcgatcagagctcactcagatccgatcagagctcagcagtctcaaacttctgaattcaagcaatcctcccacctctacctcccaagtagctaggagtacaggcacatgccactgtgcctggctaatatttttatttttgatagagaccaggtctctctatgttgcccaggctggtatcgaactcctgggctcaagtgatcctcccactttggcctcccaaaattctgggattacaggcatgagccaccaagcttggccaatagtggtttcttaatgtggtataagagggaaaacacaggtcccagctccctgtctctgtgaccctgacctgagtcttcagtttctatgagcttcatgttccccatagccacaagtaaaggaggaaataaaagctaacttatctttggtaaatcccctcactttctctttccctctctccttttgtcccctttcagctctcttttagccctctctgcctccttaaaggccctttctatttctcttctcctcctctttcctgacctttctgtaacaactggccatgatggaactaaaataattatttcattacttgatactcattgaatcaagattgttctctctttaatggacaagttcaaaattttatattcttcagaagccaagcctaataaaacctttttcaatggattatgcatttgcataaccctaaaattatagtctatcaaagaagaaaagtttcccccaactttattagaaataaacaatactaaaagaagagactagggagggaaggtcctctctgctgtatacctcctgaacttaggcctggaatcacgggatccaggaggtaagcgagaaggcaggtttgtgctcagacctgcagacagcaaagctgtgagctaagctgagagtttagagaacaaggaaggctaagggcaggttgaatgaaatcccctgtggcaggctactgaaggagttcacttgtgtctctcgatgctatacagtcatccccccatatccacagtttcgctttccacaggttgagttacccacagttgactgaaaagattaaatgggaaattccagaaataattcctatggcttaaattgcatactattctgagtagcatgatgaaatctcccacaaacccacccaggatgggaatcctccctctgtccagcatttccatgctacagacgtcacccacctttagtcatttagtagccaccctgggcgctcagatctattgtcatggcatcacaatactggtgttcaagtcacccttattttacttaataatggcccccaaagagcaagtacaaggatgctagccatttggatatgccaaggagaagccacaaaggccttcctttatgtgaaaaggttaaggttctcaagccaataagaaaaggaaaaaaaaattgtatgctgaggttgctgagatctggtttaagagtgaaccttctatcaacgaaatggtgaagagtatattgttgtaattattctattttattatcattgttaatctcttactgtgctcaatttataatattaaactttaccatagatatgtgtaagtagggccaggtgtggtggctcacacctgtaatcctagcactttgggaggccgaggcaggtggattgcctgaggtcagcagttcaaaaccagactggccagcatggtgaaaacccatctctactaaaatacaaaaattacccaggcgtggtggcaggcacctgtgatcccagctatttgggaggctgaggcaggagaattgcttgaaactgggaggcagaagttgcagtgagctgagatcgcacctttgcactccagcctaggtgacagagcgagactgtctcaaaaacaaaacaaacaaaccaacaaagatatgtgtaagtaggaaaaaaaatcagtagggttcagcactatccacggctttaggcagccactgaggtgagggtcttcaatgagggtagttcccctgcctcctcggactggggggactactgtacatctataaagagagtgaaatagatacacaggactttaactagatgacctttatgtttccttccatgaactttctctatttggaagccacaaaatagtaaaggactagaattctggtgccaggaattcaacacttattttaaacagtatctgctgtctggtgaccaccctagactctgaacttctaatcttggtatctttaaatctgaatgccttttattcctcattcagtttccactgttcttcctcaccttcctgtgtttctaaggaaaacacctgagaatgcctctcccctccccacgcctccacgatagaaaggttagtgcacggccaaccatgactgccccgggctttctccaaaacagctccattgaagaaatgatgctgagtttccattttgcacactgaccctcccatggggctcaccctctgcctttacctacgcttaaattttctctgtagcatctgtcgccatttgaaaggctattgcatttcactttttttaaaaatcatgttttccccccagagcatctgggtttttctgtgttgtttgctgctaagccaacaacatgctgggcacatagaaggcacctagatttgtcacatgaatgagcacatcctccaaaaatccccaaatttggcctggcatgatggctcatgcctgtaatcccagcactttgggaggccgagacaggtggattacttgaggtcaggagttcgagaccagcctggccagcatgatgaaaccccgcctctactaaaaatacaaaaattagccgggcgtggtggaggacacccgtaatcccagctactcgggaggctgaggtaggagaatcgcttaaacccaggaggcagaggttgcagtgagccgagactgcacactgcactccagcctgggcgacagagcgagaccccatcaaaaaaaaaacaacacagaaacaaaaacaaatttaatataaactccaaaatccatcttcagagacaagtctccatataaacataatacatggaaggttaagtgttccttcaaatgtgggcaatactctcatgcaaatttttgtataaagtggatttttctcttttttttgagacagggtctcactctcttacccaggctggagtgcagtggcgcaatcatacctcactacagcctcaacctcccaggcccaagcggtcctctcacctcaacctcccaagtagctgggataacaaggcacgtgctaccatgcccggctatttttttaagtatatttttgtaaagatagagtctcattatattgcccaggctggtctcaaactcctggcctcaagtaatccccccaccttggcctcccaaagtgttgggattataggcatgagccactgcgcctggcctaaagggggttttataaacagaactggtaacactttactttctacctgacactacacacagaatttctcagagtattatatgttttttctaaatctagtcttaataagctttcaacctctttatatatataaaatagttttctgaaatgatggtcataattttgcttaaaaaaaaacacaaaaaacattgctagtgcctaagggcacatacaatacccctgactcataaccaactgctgattcaacacctcctcctcttgggtgtctgataagcatatcaaactaaataatgtccaaacagaacaccttttcatcccacaaaaaaatcctgctcctcccaggcttctccctctcagttatcagccgtcacatctttccccttgcccagattttccaaagaaaagaaaaccttcaggtgactctgcagcccatcccttctttgtcactctttgataggacacatctaagccatccaagtcctattacttcaacatgcaaagtatatccagaaacagtcacattgaccctataaggctcaccctctgcccctgcccaagcttaaattttctactcagcacctgtcaacattagaagggctattatatttcacttttttgaaatcatgttttcccctggaggcatctaggctccacaaggatggggtttttctgtgttgtttgctgctaagccacccacacctacaacatgctgggcacatagaagtcacccagatttgtcacgtgaatgaacacatcctgtaaaaattacctattttaacatatttaaactccaaaatccattacgagtccatgatatcaacttctcagttacaaatataaatattaaataatttacagatataagtaagtctgcaatagcaaaagtttcctaaaggcctggattctgcaaatgggtttcagaaagagggtgcaaggacacacaccagtgcaaatgtgcattttctcgtaggtaagtgactgagtgctggggaggaaggaatggtgtagcccaccgccagcacacttctcgtgtaacactccagcaattctgctcagaccccaaaacctgaatgcctaaaagaaaacaaaatccttccaaagttcaccagggcctctgtccttacaaagtttcccatggcctggctccaaggggagcccgacacacctgatttcttcaatctcctcccattctctgtagtccaaaatagccattctccatgccctaaagttcaacgatcaccagacactaaagttcaacgatcaccagacacaggcatcgctggaatggatctcgcgtgagggtagagcacccacaccacaggtgttctcaacatggtcccaacccagcttatctcggcccatgaccaagtaaattaaactcaggtggcacctgtaaagctgtgatcttctgttatttttcctctaacgttcctcccttcctaaaacacgctcaaagcccattttctcatcccttcccgcttcactctactacctgttgtttctatgtcaacctaagcaacaggcaatgtggaccctgtccacctctcttccgggtcccccaacccccctccacacctgcactctgggttcaacatgggtccttccatgccataggcacctcagagatttcctactacggagcttcaaagccttctctggttcatccacagccttcttgtctccctgttctcccaccagctaatccatgcctttcacttcttcacagggccctcactttataatcccatcttcccagcactttcccacacgacaaccagtaccaagcatctacagccattgtgcatgattagccatcttagtcttcttccttaaaaaaagatgcacttggcatatttgtacacaatttagtaacagaataaaatgaagaaatgtgagtaagatttttttttaagagacaggttctcactttgtcactcaggctggggtgcagcggcataatcatagctcattgaaactcctgggctcaagcaaccctctcgcatagctgagactggaggtgcatgccatcatgcccggctaagtgagtaggatattaattatttctgcagcccaagttatgcggctgactcataaggagatgaaagcattgttcattgcaactagcaagtgaaggatctgacgactagccagagatgccatactatatagtcagcaaggcccgtgtggccacctgctagatgcagggctcattgttgccaagatccttctgagcccatcagtgtatgatgttgactatcctctgaaaatcaggccattggccggggactgtggctcacgcctgtaatcccaacaccttgggagtctgaggcaggaagattgcttgagcccagtagtttgacaccagcctggacaacatggcaaaaccctgtctcgacaaaaacatacaaaaaactggccaggtgtggtggcaggcacctgtagtcccagctactcaggagactgaggtgggagaatcacctgagcctgggaagtcaaggctgcagtgagacgtgatcgtctcattgccctccagcctgggtgacagagtgagaccctgtctcaaaaaaaaagaaaaaagaaaaatcaaaaaaaaaatctggacattaattagtgcctgttcaaatcaagcgctttcttccaaacgattaaacttcatctctcataagagatgacatagttctctcttgcttccaagctcaaataagcacttgccagactaaggaataagactccttaacaaagcgagcatctgaagctactcatttaagtttgcgcaccaagaagcacagagaataatatacaattgatccttgaacaatgcagggattggggtgccaaccccctgtgcaaccaaaaaaccacatattaatttttgactccccaaaaccttaactagtaatagcctactgttggctggaagccttaccagtaacataaagttgatgaacacatattttgtatgctctatgtattatatactacattctcacaataaagtaagctagagaaaggaaaccgccattaagacaatcattgtggaaaatcattgaggagaagatacacatggaagtggatcatcaaaggttttcatcctcatcatcttcacattgaataggctgaagaggaagaggaagatgagggattggccttgctgtctcagaggtggaagaggctgaagaaaatctgcacgtaggccgggcgcagcacacgcctgtaatcccagcactttgggaggccgaggcgggtggatcacttggggtcaggagttcaagaccagcctggccaacaatggtgaaaccctgtctctataaaaatacagaaaaattagccggacatggcggtgcacatcccagctactcaggaggctgagacaggacaatcgcttgaacccaggaggcagaggttgcagtgagccaagatcatgccattgcactcctgcctgggcaacagagtgagacttcatctcaaaaaaaaaaagaaagaaaaagaaaaaaaaagaaaatctgcacataagtggactcttgcagttcaaacccttgttgttcaagggtcaactgtgcttcactggggtcaaagaattgctctggaagctgaattacatgcatgtgaacatgtaattcacacttctcaaggctaaacaactgatagaatttagtcagttatcttgatgctttcccagattgctcaaagtttatctgtccctgggaaataaatatgagtgtctttaatttaagacatgtgtcacgtaactcagcgcacagccatgccccacacataagcctcacttatgtgagcccacacatgcctgcaggagcgccaacatgcctttccaggtgcatttgtcccaacaagaaccagatcccatttgtcccaacaagaaccctttctctctacacctttgcctccatcactgtggcccaaggcaccatgaattttcaggaccccaacagcctgctagctggcctacccaccttcacccttggtttccctgtgatctttcaatagaaaagccagagtggattcttaaaaatatcatgccatgctgctctcctgcagtagaaaaacaatgaaactcatggtggggtgctgtgcttgactgggtccccttcgttcagtgttccagccaccctggcctgatgtgtttctgacagtctcccacattcccgtttgtccccttgcgtgcgagcaaatgcttttccccatcttctcccatgattagatcttctctcctgcaggtctcaatccccagaaagtcctacccttgtgtacaaaaaaccaaacataccctcattgtcgatcatttatatcctcattctcactttctttacccatttactacaatctatttgtgtagatacaaaaaaatgcacttaattactttgtcactttcccctctagaacaaaagctctctgagggcaggatttttttatggtgttcactgggccagggaccaggcgagccactcaaaactgcggggtgaacgagtgagtgactctccacccaggctgaagagcagcagcagagaacacccacatctggggcccagcaaccctctttaagcgcctgcaggagaaggggaatgtgcaggtcacttgaggtcagtaaatgattgaacagatgctctagcctcactcaataaatcatttattattgaaagaatagtgcattgtaaagtactttcaggtgtggcaaattattaatcattggttagttttccttgaagagtctgccagccctgcctgcgggaggctgctgggcccggcctgggggctacattggggcagggtggagaaggaggtaggctgctcagagtcagggactctggagagcaggagctgggtgcagggagacacaatgacagatctcacaggaaaacccactctacctcattagaaatgccttcccccggctgggcatggtggctcacgcctgtaatcccggcactttaggaggctgaggcaggtggatcacctgaggtcaggagtttgagaccagcctgacgaacatggagaaatcctatctctactaaaaatttagccaggcgtggtggcacatgcctgtaatcccagctactcaggaggctgaagcaggagaatcgcttgaaccagggaagtggaggttgcggtgagctgagatcacgccattgtactccagcctgggcaacaagagtgaaactccgtctcaaaaaaaaaaaaaaggaagaaaaaaagaaacgccttcccctaaggcaaggtttctcagcctcagcactactggcatttggagctgaaaaactctttgttgggggtgtcgtcccgtgcactgtaggatggttaacagcatccctgaaccccaccctcaagaagccaacagcatccccatcccaagtcctgacaactaaaattatctgaggcattgccagggtggcaaaatcacatggatcagaaccaccgcactaaagttttttacagcctttctggacaggctatagaatcttaaatcaaatgttgacctcagacagaagttgcaagacaatgacagcagtcttttagccacgttagcaaatgatataaacccattagtaaatccaccggttcaattccactccaagagttcaaggcatctatgttaacaaagaattacagtaagatgggacatgttacatctgtgtagtgtggggaaaaaaaaaaaaaaaagatgggacacatgtggacacaggctatgcacagactctacttctgggctttctaagggatcaacatcccagctcacgagactcatcttctgtacagcagagtttctcaaagtgtgatctctggaccagcagcaccagaatcccctgaagagttagaaatgcaaattctcaggacccactccaggtctatgaatcaggaactctgagagtggggccctgcaatctgtatcttctgatgttctccaggtgatgcggatgcaggttcaggtttgagaacgtgccatacagcttgctttgacacaccaaatgggaagcacttgtctgacatatacgccaatactcccaacccaaccctggctcattagcaaaatccctacctcagcctggggagttttactggggagtttcttgttttgtttttcggtaaacttcaatatgttacccaattatgcctggggaattttaaaacaaaaacccacagacacctagaaccgcaacctaaatgactgaatcagaacaagccaagatgaaacccaagtggcggtccttaaaaagctcccctcacccagcacatcctggttatcagccaggtctgggaaccatctgtacggtagagagaagaaagagggtatagtcaggtacctgggaagttggagagggtttggagaaagggacacagtttgagcaaactttaggaaaagaatttggagtttaccaagaagacaaaggaggaagaagggacaaattttccagaaaaatggagccacacagccaagacttattgcttggagacagcagagaaaatgctgcatggggtctggggtgataatggggtaatcaaaggtcttgtgttctaaactcagaaagttggactttatcctaaagataacagggaaattgtgaatgtttttaagctactttgtatatgatgaactgtggaaggcaaggaaatcagtcaggaattggatttgaaagaaacttcaccaatacagtgacttgcatccttttattcaagcaaactagatcccttcaccctcccaatatccccagtctgcacaattctcacctcccctgcttggtcgtaactctgtgactctaccacaaaaataagcagatgcacaagaagtcagtttaaaattccacatcctatttctcatttactctaggatctcaaaacaagaaaaacatcgcaacccaagtcatcttttcaaaaacaattttgtaaatgtcctatttcatagaaaaggaagaagcaactctaaatcaaattttttactctgaaattacctagaattcccaggcccagtggctcacgcctgtaatcccagcactttgggaggccgaggtgggcaaatcacctgaggtcaagagttcaagaccagccttgaccaaaatagcgaaaccccgtctctactaaaaatacaaaaattagctgggcgtggtggtgcgtgcctgtaatcccagctactcaggaagctaaggcggaagaatcacttgaacccaagaggcagatgttgcagtgagccaaaatcacaccactgcaactccaccctgggcgacagagcaagactccctatcaaaaaaaagaaattacctagaactagcatagcagtaacataaaaagctgtatctatgagcagctcttcttatccacaaaacatatcttaaattcattgtcattaaaacaagatattagaaaggaatggcttatccatttactagtattaatggtgacatggctattgaagaagaaaaaaacacaaaaaaaagtaataaaccttatatacagagttttacacaattagaactccaatcctacattgactgaagacagtaagctagcacattagaggtgcaagatgtacaataccaataaacagtcaaaaatctactgcattactatattctaatgatactgaaaacgttaataagaaattaacttcaagccaggcatggtggctcatgcctataataccagcgctttgggaggctgaggcagggggatctcttgagcccaaatgttcgagaccagcctgggcaacatagtgagaccttctctccacacaaaaaaaaaaaaatttaattggctgggcacagtggcacacacctgtagtcctagccactctggaggctgaggtaggaggaatgcttgagcccaggggcttgaggttacagtgaacaatgatcaaaagtatccactaggttgggaggccagcctagggcaacatgcctggggggcagctctcagcaagttcacaagcagcagcctgggagcacagccctggggccccgcacaccaggtcccaggaacactctctgcaaggagatggcccacgtggctggggccctggtgacaaacaagaggactgagcaaagaagtcaacgtgttgaggacagcaggagtcaagtttctcactactgaaggatgaagatacaaatatggaaagagggagaaccagaacaaagcatgagatttttgaactgtgatttgaagcactggtgtgaagtctatctaatttgtttcctaatacagatctatataaatagatacctaaataaagatagagaaatcaatatacactgatcctctttagtgacaaatcctgtatttgtgagtttgcctacttgctaaattgtaaccccaaaaatcagtcctccaggtgtcttgcagtccttcacggacatgcacagagtagcaaaatatttgagtcacccaacatgcatgctcccagctgaagtcaaacgaaatgacacttagacttttttttttttttttcccaagacggagtctcactctgttgcccaggctggagtgctgtggtgcgatctcggctcaccacaacctccgcttcctgggttcaagcgattctcctgcttcagcctcctgagtagctgggattacaggcacacgccaccatgcccggctaatttttttgtatttttagtagagacgaggtttcaccatgttggccaggctggtctcgaactgctgacctcaagcaatccagccaccttggcctcccaaagtgctggatttacaggtgtgagctaccacgcccagctgacactctgccttcttattcccgctcttagagtagaaacaactgtccttcttgtgggctgttcagtaccatgttcttcacattttggggacttttgtgggtgacttcgctgtctaaagtggccccaagcatcatgctcaagtgcagtctagtgcatcaaagcgcaaggcgggtgtaatgtgccctacagaaaaaaacgtgtgttacagaagcttccttcaggcatgaactatagtgctgctggctgttaattcaaggttaatgattaattatatattaaaaaaggtgtctctaagcagacacatgcataaaacaaggttatatattaaatggctgacaaaaatgtgaccaaaggcgcataggaacctaaccctgtatttcgcctggaagcaatggttcagtattcactagtcctgtgtttgtggagactttatagagctccactagtaacaagaaccaactgtatatgtatatgtgtgtgtatatatatacacatacacacaaatatataaataatatgtgttgatctgtgtatgcaaatacattctagctttgtccgcttagagttcctagaagcaatgagatcccataacaataaatatgcctaggccgggcacagtggctcacgcctgtaatcccaacactttgggaggccaaggtgggtgaatcacctgaggtcaggagttcaagaccagcctggccaacatggtgaaaccccgtctctactaaaaatacaaaaattagcccagcatggtggcatgcacctgtaatcctagctacttgtgagactgaggcaggagaatcacttgaacccaggaagcagaggttacagtgagccgagatcgtgccactgtacttcagcctgggtaacagagactctgtctcaaaaaagaaaaaaaaaaaatgcatagtacccagcactctttctaaatatagtatccacttatgaaaaagaatatgtaacttttctttttaatgcagaggctcttttgagaaatggctgaatccaagatcggggcagaagaagtacaagacatgtctgaactatctttttgtgccacaaaagtaatgaaatgttcaaagaatcccgacaacatgtccaaaggacccaggagctcccactggccaaacctgggacaatctgagcaccaaaataaatcataagtgtaatggattcaaatctaataaataaaattattcataagtccatagtgctataaataaatgagtgaataaatggggaaaacagaatatttcttactgtagaatgccaaccaattaagaacagaattaacaatagaatcagaaaaaaaaaaatcatcatttggcaacttccacagtaataagtgattcagttattgaaaagccatccacggttgctaaaatcagtgggtaaaagtttcatgagaagcaagatattttcatagcctccaattatctccccataaaacacttacctaaaagcataaagtattgcataatcaactttagaacagggaaacgtggcagacaagaccttaacagagtgataacagttaccatcaccactgtgtgcctccggatacaatgcactgaggatactgtatttatttttatggtatttctgctatgaagtcacatcacatttttttgtgtctttgaagaatattctagaatgtgatgacctgaatatttttcaaactatcaaggacatgagagacaataaaagactgcagaagtgttcgaggctgaaggatactaaagaaatatgagcgctaaatacattataggatcctgggcccaaaaaattaatatagggaaactggttatggagtttgaagataaatttctgaattttgttgggtgttctataactatgatggaaagtgcctttttatttaagaaacatgcactaaaatttaggtataaggggcctcagatctacaatccacttttttttttttttttttttttgagacagagttttgctctttctctcaaactggagtgaagtggtgtgatctcagctcactgcaacttccgcttcctgggttcaagcgattctcctgcctcagcctcctgagtagctgggactacaggtgtgcaccaccacacctgactaatttttgtatttttagcagagatggggttttgccatgttggccaggctggtctcgaactcctgacctcaggtgatccactcacctcagcctcccaaagtgctaagattacaggtgggaacaaccacatccagactacaatccactttcaagtagttcagataacaaaggaataatataaacagagaaagagacattgacaactatggtagaagctaacaggagggaatctggatgaaggatatacaggagtggtatgtatgcaccactcttgcaacttttctgtcaggttgaattatttcaaaataaaaagttaaaagacactaccagatgttaaagtatttcaaagacaatgattaaaactctagagtactggtttaaaagcatgacacaataagaaaaaaaaaaagattaaaagtataaaaataaaaggttaacaaggtaaaacatgaaattagccaggtacagtggctcatgcctgtaatcccaacactttgggaggctgaggctcgaggactgcttgagtccaggaatttgggcaagtaggaaattactgaacagctgctatcacagacaaatgcctaacattgtgaagtgctacacaggggaaggagacccacgctaagaggagagcatgcacccagacacagaactcagaggacacagttcaaaacacacatacaagaggcttaggcacctgtgggcgtgtgtgtgctcacagccagcaaaatgaaaaaaaatcccagctctgaaggagaggcaagtgcatggcttccgtacagattgaaaatatgtcttagcatgaaaattaaatatgcttacccaaggcagacttagataactgtgaagggggaaagactaaaatggggggaaataaggggccaagattacacaaaaggtcgggctgtatctgtcccccccagtcgccagcactaacagcacttagtgtgtgccaggcactggttcaagcattttaacgcaatcctcacaatcctgtgaagtaggctcctgaagggggtttaatggtggccccaaaaagatatgcccaagtcctgacccccagtacctgtgagtattacctttcctggtaaagaattgaatgttatttgggaaaagggtatttgcacatggaattaaactgaggatgttggagtgaagacatcatcctggattatccaagtgggtcctaaatccaatggcaagtgtccttccaagaaagaggcgggggagacctgggacagacagaagagaagagaaggagatgtaaacacaggtagagactcaagtgatgcagccacaagccaaggacactaaggacggccggcagccaccagaagctggaagaggcaaggaatattgtccccaccataccaagggaacacagcctggattttttaccttctggcctcctgaacttaagagaataaatgtctattgtcttaaaccaccaagtatgtaggaatttgttatggcagcctcagcaaactcatacagtgctgttatcaccattccctaaggatgggaaaactcaggcatatggcagacatgtagctgtcctggggcacgcagtttgcatgtgacagggctgagactagtccagacagcagagttcagagccctcgcaccaacaagcgacaggctctcgggagccagccaggccatcttcccccattagtaaatggggcattatccctttggtgaggtgcctgggtagcattggcccctgggctctctcctgtttctgtgcactgcattaccagctgatatggtttggttgtgtccctactcaaatctcttttttttttttttgagatggagtttcgctctgtctccactcaaatctcatcttttttttttttttttgagacggagtttcgcccaggctggaatgcaatggtgccatctcagctcactgcaacctccacctcccaggttcaagtgattctcctgcctcagcctcccaagtagctgggattacaggcaggtacctgccaccatgcccagctaatttgttttgtatttttagtagagatggggtttcaccatgttatgttggaaaggctggtctcaaactcctgacctcaagtgatccacccacctcggcctcccaaagtgctgggactacaggtgtgagccattgcgcctggccatcaaatctcatcttgaattgtagctcccacagttcccccgtgttgtgagagggcctcggtgggaggcaactgaatcatggaggcagttctttcccatgctattcccatgatagtgaataggtctcacgagatctgctggttttataaagtggagtttccctacacaagttctcttgtctgccaccatgtgagatgtgtctttcccttctgccaggattgtgaggcctccccagccacatggaactgtccattaaacctctttcttttgtacactgcccagtctcaggtatgtctttatcagcagtgtgaaaatggactaatacaccagctcccctgacttgtcttctgcaaagctctacaggcatggtgacaaggggctgggtggtcaaagtaaacagggccagagaaatgaagagtaaggagtggaggggaaggaagtcatataataaagaatttggctgggttttatccctggttcttctaaatccttggaatgctccaagtaatagaagtgtggtccctgatggtttacactaacataaattatcagggacataatataacatagtgggtccctagcagctgatgctaacagatgactcaggatgggggctgtgcatatcacaaagaccaatcctgtgatgagagggctgggcttggagccaactgctattgcccaacctccagggcagggggtactggagactgagatcaatcccacagccaatgagcccgtcaatcgtgccgatgtaatgaagctccaataaaaactccagacaccaaaacctggatgagatttcctggctggcaatactctgggcattgtcagacactactatgtggggagaagaaagagagatcagactgttactgtgtctgtgtagaaagaagaagacctaagagactccaatttgttctgcactaagaaaaattcttctgccttgagatgctgttaatctgtaaccctacccccaaccctgtgctcgcagagacatgtgctgtgttgactcatgatttaatgaatttaaggctatgcaggatgtgctttgctaaacaaatgcttgaagacagcgtgcttcttaaaagtcatcaccactccctaatctcaagtacccagggacacaaaacagtgcgaaggctgcagggacctctgcctaggaaagccaggtattgtccaaggtttctcccatgtgatagtctacaatatggcctcgtgggaagggaaagacctgaccgtacccctgcccaacaccctaaagggtctgtgctgaggaggattagtaaaagaggaaggcctctttgcagttgagataagaggaaggcatctgtctcctgctcgtcccttggcccttggcaatggaacgtctcagtgtaaaacccaattgtatattccatctactgagataggagaaaaccaccttagggctagaggtgagacatgctggcggcagtactgctgtttaatgcattgagatgtttatgtatgtgcacatcaaagcacacagcacctttttcttaaccttgtttatgacacagagacatttgttcacatgttttcctgctgaccctctccccactattaccctattgtcctgccacatccccctctccgagaaataatgatcaataaatactgagggaactcagagaccggtgcctggggcgcgggtcctggcgcgggttctccgtattctgagcggcggtcccctgggcccacttttctttctctatactttgtctctgtgtctctttcttttctcagtctctcgtcccacccgatgagaaacacccacaggtgtggaggggaaggccaccccttcactaataggctaggaagtgacaggtctcaactccctggagatgggacaagaaagctttgtatttgggactctccctttggttccaattggcagccatttgctgtagtaaaactgtaattgtaagtgtagcactttcctgagttctgtgagtcattctagcagattattgaacccaagggggtcatgggaagcatagaatttgtagctggttgactagaagtcagggtgggctgggccaccctgatttgccatacctaaatcttccaaatacagagcctacaacctgtcagcagcacaagcagctcacctgctagtctggtggctgaggcaggaggactgcttgaacacaggaggtggaggctgcagtgagctgagactgcgccactgcactccagcctgggtgacacagcgagactccatctcaaaaaaaaaatatatatatatatatatatatatacacacaacattgatcaagatttaaaagtaatacagaccacaaagagtttgaagttgactttcagttctttctgagggaagggaggagcctggaattgagacaggacacagaacagggaccagcaaaatcttatttcttgatctggttgctacttaccaggatgttaaccttataatttattatccacgttacacatttgtttgtataatattctgtatctgctttataacataaaggttaaaaaatgtagtgagaaggtacacaatgtgatttcaatggataatttaacagtgtatatataatcgtatactgaccatttcctacagatacatctgaaaattacataacaaatgcatggtgacagtgtggggttttgcaagaaaagaaaagaatagagaaaagaaaaacagagcaatgaaataccattcttcacttcactcatcagatgtgccaaaaaaagtaacacttctagggcaggaaatgagtagaaggagggttaagattggctgggaattgatcattgttgacagactggtattcaggggttcattactgttccctctacttttgtacatgtttgtaattttctgtcataagagaggataaaggaagggagggaggaagacgaccagaaaatccacatttgtatagctcttcaacgttgggcatttgataggcattaggttttctccatgaaaagagggacagtcacccaactattaatattggtgttatctgtagttggaaattaaattaatatattttgttagtattttctctaatcaacaatgactgtgggaaggggaagagaaaaaatgacttttttcatcttttaatacagtgatttaagaaaagtaaatattccacattaccaggctgtgaaaaaaaaaaaaaaaaagaaagaaaagaaaaataggaaaggaataagaaaaggtgggcgtaatagtgactgctgaactacaaccacagcttagctcacctaatccattccttggcccatttgtgggtctgacccttccttctcccatcattcctggcacagggtttgactttattacccacctcctttgcagtttggtgagaccctgtggcacagaagagaaagggaggtctaccagcagcagcccagcgtcaaccaagcacacaacagggggctggccagggcccacgcatgagatctagtagagattctgatactaagtctgggacagagcatgagaacctgtgtttctccccagccccagatgatggcaatgctactgtctgcaaaccacactgagtagggaagctacaggcagagccaccacgcatgagtttctcttctttcagatgcctcatagatggtggccaaatgggccgggcacggtggctcacgcctgtaatcccagcactttgggaggccgaggcgagacgattataaggtcaggagatcgagactatcctggttaacatggtgaaactccatctctactaaaaatacaaaaaattagcctggcatggtggcagccgcctgtagtcccagctactcgggaggctgaggcaggagaatggcgtgaacctgggaggcggagcttgcagtgagccgagatcgcgccactgcactccagcctgggggacagagccagactccgtctcaaaaaacagatggtggtcaaatgataagcagtggaaaaatacacccaagacgacccaagaaatagccagatggcctttctctcttgacccataacaaagtttagctcagatctatgattaactccagttagtgcagctaaataatgaatacagagacagctgccgacggattacattagtgtgcaatgtgataggggctggctgggctctaccaaaaacataatctgccaccctgagtcagagacagggctgtaaacaatgagatctccaaaggcagtcactgctggcctaggaagcagaggataagaaggtcacacgctggcctttggttcgcagaggtccccgtcagctgtgccattcttacaaagaagcctacacagaggttgtttattctctaaggccacagctatgattaacagattattactctataaaaccacagcaagtatttgcgttacctcagccctcaatatcctagcagtccggtatttatgaatgtcacaatgtttgtccaaaaatttcaggaagcggagaacttgtaccaaacctcaaggatacgttgagacactgatctgtaatggaaccttcttggttccttagctttatgttccttttctatttatataacaaacagacattggtcctaacagaaacagagcacgcagcgtgacatagctctgcacgaaactggaaggagacaagcaggattccctgggcctttaatcaccattagccaacagcctggaaaacagacgggactcaatccaaaaagctcctaaccacccaagaagtctgatcacatgcctctccccaccaactttaagaaaaagccagtttgaactcacaaaaaatctaaattattgaatatacacaaagaggtgcaggctgattaatctctagtacctgagataacttcctcagaggaaatgctccagcatgttctttaagcacatatttttttttttttgagacgaactttcgctcttgttgcccaggctggggtgcaatggcacgatctcggctcactgcaacctccacctcctaggttcaagtgattctcctgcctcagcctcctgagtagctgggattacaggcacccgccagcacacccggctaattttttgtatttttactagagatagcgtttcaccacgttggccaggctggtctcaaactcctgacctcaggtgatccacttggcctcccaaagtgtgggattacaggtgtgagccaacacgccaagcctctttgtgcacataaagtgtctgtggtaaaatgtgtttacaacattctctaagcaatctaatttatactgttcatttgccctaaaaaaacctttcacagacagagaaaaaagtactttccagcccagtttctgtttaaatgaccacaaatttcatattcaaacatgaaatctaaattaatcctgtgaattaatctaaattaattcagtggattataaactccacaaggccacagattgattttagcatctagtactaaacatgtggggccgggcacggtggctcacgcctgtaatcccagcactttgggaggccaaggcaggtggatcacctgaggtcaggagtttgagaccagcctggccaacatggtgaaaccctgtctctactaaaaatccaaaaattagccaggtgtggtggtgcatgcctgtaatccccgctactcgagaggctgagacaggggaatcgcttgaacccgggaggcagaggttgcagtgagccaagatgtcaccattgcactccagcctgggtgacagagcgagactccgtctcaaaaaataaaaaaataaaaaaataaaataaacatgtgctggacaaacctaaacacctgctacctaacacaaaatcatacacacacacacacaccccctacaggaccccaatgactttatatgacaagaaagaaaacaaacagatatttaggcataattaacctggaaaacaggttgggctcataaaaatcccagaaattttatctatggcaattgattttttttatcctaattcaaagagcaatttatgaagaagatggtccctgcttatctggaatgttccctgaaacttccaaaccttttaccaaagtcgccaaaccaatagcacatgtgttacaattatttgggggcattttcttttcctgacgtttctttcagctttgacaaggtagggcctcccacaacgtcagagtgaggttcaggtgcgagtgtgttttgctcagccttaccgcagctctgtcggcctggatgggcgtggggtcccaaataacaccctctaggccatggcttcctttctttcctggccccttccctcaggttgtgagtctttagcccacctagcagactcagggtgtgccaccagttccctggaggagcagatcattgaaaatacagcaaagttaaaattaaacgcaacaaggccaggtgcattgccttctgttccatggggactatttgtcctaagactttgactgagcaccatggaccctcctgctctgtcaaatgcctcttcctgctggctccaggtttacactactgatatggctctgtgtccccacccaaatctcatcttgtagctcccacagttcccacatgttgtgggagggatccaatgggagataattgaatcatgggggcgggtctttcctgtgctgttcttgtgatagtggataagtctcacgagatctgatgggttttttttttggtttgtttttttttttttttttttgagacggagtcttgctgttgcccaggctggaatgcagtggcgcgatctaggctcactgcaggctccgccccccggggttcacgcgatatctgatgcttttaaaaataagagtttgcctgcacaagctctctctttgcctgctgccatccacgtgactttctcctccgtgccttctgtcatgattgtgaggtctccccagccacatggaactgtaagtccactaaacctcttcttttgtaaattgcccagtctcaggtatgtctttatcagcagcgtgaaaacagactcatacaactaacaagcctgctttagcttttcactgttctgcccaagcaactttccccttcagccaggccagtagatttctcatacagcagggtgaccctgttcagggcctttgtactgtttatattttttactttgtgcatactatgatgtcttgacgttttggaaacctctctggctggggagagactgtccttcccagagctggccagttcttagaaccagaagggcccagccaggagcacagctctgatatgcaaaccaaccaacccagagctatgccgtctttatctagcctgtccaccccaggaagcagtatttcttcacctatatcatgccagagcctgataacaagcaactagaaaccatgcctgtagcttacagcctgccaaaattattcaaactagccaattctaaactgttcacatgcactcccctgccctgtccctgaaagctcaagaaagaccatggcccaggctctcccctcactcctgccccttcaggctcctacaggggggaccaagactgatgcttccccatgtggccctgcagggcatgacatgcttcccgtctctaagacctgtgagtataataaccttggccttcctgagcacctcctctgcctcctcctgtggccacatctcactgaccatcacaaaaaacaacatagaataagccaggcatggtggcttatgcctgtaatcccagcactttgggaggccgaggcaggcggatcacttgacgtcaggagttcgagaccagcctggccaacatggtacaaccctgtctctactaaaaacacaaaaattagccaggtgtggtggtgggtgcctgtaatcccagctactcaggaggctgaagcaggataatcacttgaacccgggaggcagaggttgcagtgagccgagattgtgccactgcactccagcctgggcaacagagcaagactccgtctcaaaaaataaaataaaacaggttttcattttaatttttaacatataaacctccacaggaacattctgacacagacttcagccccaggcctacatcaccctatgatccaaattattttatagtaaatggtatgaagtttggagaggaagggcaatttggccatcatgctgtgattttactgcaggtaaagtagaatcaccatgaaagtggtggagccttgctttttctttaatttttataatgccaccaccctacattcttaggagaaaaggcaaggagttaaataaataagcacagatttaagttcacatttctggtaattatccgcaagctaataactgagattgcttaagctctgtaaacaaaacacacaaagcccttgtggctctgcgccagaatcaaaggtctgatccaaaactcccccatccccttgttggctttgaacatgaaaccaattttctacaccaaatcaggcctacttctttgtaaccatccttaccatctctcttataggaaaatgtttaggactcttggcggtgactctagaactaggaaatcaactctctcagcagcactctaatgagcaaaaacaactgtgcctcaaaatacaggctgcagtgggcagaaatctctgtactgcactccagcctgggtgacagagtaagtttctgtctcaaaaaaaaaaaaaaatcaagtaacaaagaacagctgtctaaaactgttaacactgattcaaaatataataacctttatgcctgttattcagagttaaagtgggtacgctaattataaatcatacacttttctaattgtgcaatactctgtcaatgggatagattttaggaaaattccagctgaaccagtccattctttgaatcattaggtcaattacaaacatgccaatccttagcctgaatagctgcatatttagaaagacctaaaacattcttcaaaaagctgccatacatggtctgttaaagggcttacttggtaggaaataaatcaagagggaatactccatagtgaatctcagggcactttttaaaacaaatctcagggctgagcacaatggttcatgcctataatctcactgctttgaggggccaaggcaggaggattgctcaagcccaggagtttgagaccagcctgggcaacatggcaagacctagtccctacaaaaaaattgttttattagctaggcatggtggaacacgcctgtggtcccagctattccagaggctgaagtgggaggatcacttaagcccaggaagtcaaggctgcagtgagccatgatctcaccactgcactcgagcctgggagacagtacaggacccatctccaaaaaaaaaaaaaaaaaaagtgaacgaagctgcaataagctgtgatcataccactgcacactagcctaggcgacagagtgagaccctgcctcaaaaaaaaaaaaagaaaaaaagaaaaaaccaattgataaaagagtaacctcccaatccccagctgtggaacccaagagcagagaaggcagccacccgcctctctttccctcaaagacaccagagtgcaataggctcttcctcactcattcccatgggaagtagccttcaacccctctcaaaccacagcatatagagatgcctttattaataaaaaaggatacaacccacgggccagccgcagtggctcacgcctgtaatcccaacactttgggaagccaaggcaggcagatcacctgaggccaggagtccgagaccagcctggccaacatggtgaaactctgtctctactaaaagcacaaacattaaccgagtgtggtggcacacgcctgtagtcccagctacttaggaggctgaggcaggagaatcgcttgaatccgggaggcaaaagttggagttagccgaagtcgcaccactgcactccagactgggcgacagagcgagactcagtctcaaaaataaataaatacaataaataaataaacaaagtatacaacccacaactcacttttttttctaaccaggaatctcaacaacaggactatagggaaacaagaattattaacctcattaattcaaattaactcttaagcacccaccactaacaggcactcttataggttctagacctaggatcatttttacagagttcacattggggaagggagaggggagagggaaaggcaatcacactaaaaagagggggtcagagtaacagtaagatccacacagaaggccaggcacagtggctcacacctataatccaagcactttgggaggccaaggagggtggatcacctgagttcaggagttcgagaccagcctggccaacatggtgaaaccttgtctctaccaaaaatacaaaaattagccgggcatggtggcgggcgcctgtaatctcagttatttgggagcctgaggcaggaggatcgcctgaacccaggaggtggaggttgcagtgagctgggaccatgccattgcactccagcctaggcaacaagagtgagacttctcaaaaaaaaaaaaaaaatccacaaagaaagtagggagccatggtagtgaatgggggcgtttactctagatgggtggtcaaggcagagtttcccaggaggacaaagcccccagtgacaagagcagggtcaacaagttccaagcaaagagaacagcaagtgctgaagcctaaggctaatgcacttacagaaaaatccttaatgactaagtgtgttgcctctgtttgcgcagagatcacaaaacgtgtcccgcagaagggagagaaaaagggaccccaggagagggtggcggggcttcaggtcctggagaaaggcagcaagcatggctaacacattccttggtccaccctgcagggtaatactgcaccttcaattgacttatgaagaaactagctcagattggaacaacagccaggacagtcaccaccaaggggacttgccccactggagaaggcaagtctgaccccctaccccaccgcggtcaacccagggacggaggagagaacgccgcatgccattgttcttatgtataaagcacaggttacaggttatttctgaagatgtctgctcaagtggagatgctaccaggtttttaccaatcattactttggataaaagtttagcaaatatttacatcactgtgcccacagtttgtgcttatgccccatggctttagagggcccgtataccttatgtatacttcatattatgtataatatgaacttcagctccattcatggtcatatcatctaacctgggatactcttaggagtgaaagggggagcttaatagtggcagtgtgataagggatataaaccaggattctcctgggccaactggtacaggtgaaaaggatgactgaaacggcagaggtcctccattcttctagatgggtgatcaaggcagaggttcccaggaggaccaagcccagacagagaggcaaggggcggtggctcacgcctataatcccaacacattgggaggctgaggtgggtggattgcatgagccagggagtttgaaagcagcctgtgcaacatggtaaaaccctgcctctacaaaacaaaaacaaaaattagccaggcatggtggtgcatgcctatagtcccagctactcaggaagctgaggtgggaggatcacctgagcccgagcacagggaggttgaggctgcagtgagctatgatcgcaccacttatactccagcctgagagacagagcaagaccctgtctcggaaaaaaaaaaaaaaaaaaaaaaaaaaacacagactgacaacaactcaatgaactcagataattagaaattctattagtctaatttcatatgaaaccaaggtattttttttttccttcctcagagaccggagtgggagagaaactgttacagccaatcacttccttccaggaaaaaaaaagacgcaaataacaacacaaaaaaacgtgatctaatagacaatccagatataaagaacacaaacccttttccctacaatttaaccaaatgctaaaatgcaccaggaaacacaggatactacagagataaagatttggccagcagattatcaaccccaggaaaagaaatccatttctgtagcatgctatgctgttggaggcacacgtcacacttcttaattcaaggacagaaaagcacaaactaaaatgcacactggagtatgactcccccttctctatctgctaaagcgcttcgcatgtgactttcaatctctaagctgggaatcaatcaggcagcccagcctcctatattttctagttgtattgctttgagcatcaaatttaacctctgtgcacctcaatttcttcagctggagacaaagaaagtggctgcactgtggcagagtgtttgcaaatgttaatcatggttatggtagcattctaccttgtcttacagatggttgcctaaaaaggtaggaaactgttcacgaaaaagtctcaaccggtcctagagtgatcagaatgacagcgctgaaataaggagggcagtacctcttattccagagaagtggggagcagagaggaagatggagtggaaaggggcgaggcaaggccctcctgaaatacctcaacccaaatcttcaagaaatccccaagtcctcacagtgctttttgtggatttttgtggaaaccggtaaaaggggctgatttgctgaccccagtgggtagaaaacagagactgtcaagagaacagaagagaaggcagaaaggggatggggaagtggggttcgccatgttcacgagctcctggagccacagggccccccaggaacaacagagctgagactgggtggccttgtttctggcccaattccctgggaccaccaccctggaaggacacttgagccctactcaaggacccaccacaacatctcagcattgtcggtccttaaatgccaaggtttgtgctcaccatttccatccttaagattctcacagggaagaacccacacaacagctttgtccctgcgactctgggtgagtttctgacactggcctgggctcccgttttgcccgtcaccaacttctcacagtataactatccaagagaagtagcatttgatgtcagggaatcaaaagggctaaggctcgggaggccaaggcaggtgaatcacttgtaatcaggagttcgagaccaccctgaccaacatagtgaaaccccatctctactaacaatacaaaaaattaaccaggtgtggtggcaggtgcctgtaatcccagctactcaggaggctgaggtaggaggatcacttgaacccaggaggcagaggttgtggtacgccaagatcatgacactgcactccagcctgggtgacagagtgagactccatctcaaaaaaaaaaaaaaaaaaggcctaaggcttactcagggtcatctatggtttgccaagcagagttcaatccaatcaacaaaaccctcactgcccacttttccaaaacctgatatagtcagtcactagtagctgccatttgctgttttgccttctattaaaaaaaaaaaaaaaaaaaaaaccatccaattcccagaagtcaaaggcaattccttcccttttctgtgtctgtgagacggctctctgtgggattccttcctgctgcacctcatccttcctggaagggactctcagaaaatgtgcctcctccttacaggaaaggaattcctcccgaggaactgtggacatgaggcagctttgtggaatttcccttccacagacttcagcctattttctgggcaaacttagcagaaatgaccaaaatccactcgagagagacagcaacaaggagaggggaagagatcctattttggcttcttcaaatggaccaattttctctttaaaatatttattttaaggaaaaacaaggactacattatattttaaagggggagaaggaagaggattttgagttgctaagagaacagagccatctcttttcttttaatactggatgctaagaacttgcacagggttttcccaaaagccagatagttcaggtaatttgcatgtggctgtaaaagagaaagttcaggccaggcactgtggcaacatggtgaaaccccatctctactaaaaatacaaaaattagctgggtgtggtggtgcaagcctgtaatcccagctacttgggaggctgaggcaggggaatcacttgaatctgggaggtggacgttgcagtgagccaagatcacaccactgcactcctgggcgacagagactctctcaaaaaaaaaaaaaaaaaaaaaaaaagagagagagaaagttgagagcataagtctgagtgattctgcctgaaagaacagaacagcttacactggacaggcttttgcccaagacacacctcatctggcattgagaaacgaacaccaacaataatgagtgacagaatgttaagaacaataattatacagacttggacctcccagactgcttgtctgtagtaattcagaaggaagcaaagtattctgaagtgtttatgaagattggttccacatctgaagaattttagtaatcttacccaaactcaacccaagaaatatgaggaaaagagggagtagttctataataagcaggtggaatagagggtcaaactccttggcgagttcagtctaacagaggacacattactgccctacaaagcagctctggaaaatgacaaccagtggcactaactccaggcaatatctttgtgaggcttgtgggctgtaatatagtctgctcaggctgccataaaaaaaaaatcacaatcaggccaggcactatggctcacacctgtaatcccagcactttgggaggccaaggagggcagatcacctgaggttaggagttcgagaccaggctggccaacatggcaaaaccccgtctctactaaaaatacaaaaattacccggatgtggtagcacgcaccggtagtcccagctactcgtcaggctgaggcaggagaattgcttgaacctgggaggggtggaggttgcagtgggctgagatcacaccactgtactccagcctggacaacagagccactgcactccagcctgggcaacagagagagactccatcttaaaaaaaaaaaaaaaaaatccccgtcttcaaatacaatcacattctgaagtactagagatcaggactccaacatgcgaactttggggggacataattcagcccgtaatatgggtgataaaggagcaggtccagacttagagaaacaaggactccctgggtcaagctctggaagtgaaaggcttcttcaaagacaggaaagtcccactgaaggtggctttggaagtgcacccttgcagcacagcaaccttcttgatttgctcaagagcaggggttctgacaggtctcaaagcactttgtttaatgaaacagaatcgaaaataccagtgtgtcacatgtttcctaagacaggacactgtttcttgaaacttttactaaagtatgtttttcttttatttttttattttttattttttttgagaaggagtcttgctctgtcgcccaggctggagtgcagtggcacaatctcgactcactgcaacctctgcctcccgggttcaaacaattctcctgcctcagcctcctgagtagctgggattacaggtgcacgccatcatgcctggctaatttttgtatttttagtagagacagggtttcaccatgttgaccagtctgctctcaaactcctgaccttgtgatctgcccaccttggcctcccaaagtgctgggattacaggtgtgagccaccgtgtccagcctaaagtatgttaaatatgttatgtgtgagagagagaaagagaatatatctcttggtcattacatatgtaaaacttgtagaacgtgatcaaaatgtttaaaaactggccaggcacagtggctcaagcctgtatcccagcactttgggatcccaaggcaggtggatcacaaggtcaggaatcaagaccatcctggtcaacacagtgaaaccccatctctactaaaaatacaaaaaattagcctggcgcggtggcacgcacctgtagtcccagctacttgggaggctggggcaggagaatcgcttgaacctgggaggcggaggctgcagtgagctgagatagcgccactgcactcctgcctgggcaacagagcaagactccaactcaaaaaaaaaaaaaaaagtttaaaaactggtcctgtggcagtgggtctcaaacatcagcatgcatcagaatcacttggaggactgattaaaacacaggctgctgctgatgctgctaatcctagagccaccttgaagtttttctgtggttttttttttttttttttttttttttttgagacagggtcttgctgtctcccaggctggagtgcagtggtgcaatgatacctcactgcagccttgaactcctgggctcaagcaatgcccccatctcagcctcccaagcaactaggactgtagctagctcctaactcattccctccattcctgccctcccctaactttatattgcagccagaaggatattttttctgaagagcatctcatgctgagtggcagcagaatgcagagattaagagagggggccaggcacagtggctcacacctctaatcccagcactttgggaggccgaggtgggtggatcacccgaggtcaggagttcaagaccagcctagccaacatggagaaaccccgtctctatgggcgtggtggtgcatacctgtaatcccagctactagggaggctgaggcaggagaatcacttgaacccaggaggcagaggttgccgtgagccgagatctcgtcattgcactccagcctgggcaacaagagcgaaactccgtctcaaaaaaaaaaaaagagtggcgccaggtgcagtggctcacgcctgtaatcccagcactttgggaggccgaggcaggcaaatcatctgaggtcgggagttcgagaccagcctgaccaacatagagaaaccccgtctctactaaaaatacaaaaaaattagccgagcgtggtggcatgtgtcgtatgcctgtaatcccagctactggggaggctgaggcaggagaattacttgaacctgggaggcaggttttttgttttttgttttggttttgtttgagattttggttgttgttttttggggtttttttgagacagggtctcactgtgttgtccaggctggagtgcaggggtgcgatcatgtgtcactgcagccacaacctcctgggctcaggtgatcctcccacctcagccttcctgagtaactgttactacaggtgtgcaccaccatgactggctaatttttgtattttttgtagagacaagagtttcaccatgttgcacaggctgttcacaaactcctaggctcaagctatccacctgcctcagcctcccaaagtgctgggattataggcatgagccaccttgcccagccaactgagccactttgtgccaggactaggtcaggtacttgggacatatacaggcaaggacactgcccacagggaactgacagtgtctagcagctacacagatgacacggccttttcggcagacacccctgtcccctgtgcttggcaaacagcagagactcaaaaatgtatatggtttgactcccactggaacataagccccttagggcagggaccagggtcactgtattcccagcacctataatcaagaggtacatgacgctgcagctgagagcagggactctgtgctaagttacctacctggtttgaacctaggctctgccactcaaaggctgtgtgaccgtgggaaataatagtacccaccccaaaggtttgttattagtatttaataatatttattggtaaggtacttagaatagcccccctgcctacaggaagcagtacataattataatgtctaaatatacagtagttccaggccaggcatggtggctcatgtctgtattcctagcagaatgagaggccgaggaaggagaatcatttgagtccaggagtttgagaccagcctggataacatagtgagatctcgtctctacaaaaaataaacaaaagtaagccagacatggtggcacatgcctgcaatcccagctactcaaaaggctgtgattagagaatcacttgagcccaggaggtagaggctgcaatgagctgagatcacaccactgtactccagcctgggcaacagagtgagactccgtctcttaaataaataaataaataggggccaggcgtggtagcttacacctgtaatcccagcacattgggaggctgaggcgggaggatcacttgaggacaggagttcaagaccaacctgaccaacatggtgaaaccccatctctactaaaacacaacaatcagctgggcatggtggcgggtgcctgtaatcccagctattttgggggctgaggcaggagaatcacttgaacccaggaggcagaggttgcagtgagccaagatcacactactacactccagcctgggcaacagagcgggactccatctcaaataaataaataaatagcagttccatatcctctgaataatggactagaagttggttaatggatgggttttcagggagaattttagcagccgagctgagaggtaggtactctagccagggtatataacatgagctaagggaacaggacagcaaatataaggtgtgatcaggggaaaggcatcatatattgactgtccaggaacaatggatatctgagaatgtaggaaagctaagttaggaccaggaaaaggagagtattaaatgccaaagaagatgccaccaaaggttctggaacagaaagcagcagagctatgccttgtaaagataaagcctgcagtgtattgactgggttggaatctggaatcattgcgtgcctccagtcaagacgtggcaactgaccaactaccttttatcactgaccagactcttccctacgtgcagataactgaggacgcaagccttagttactgggtgtggtggtgctattaacggaaaaagggaagtcagccagcaaaggctgactggggcaatttcagccttgttgctctgctgtgaaactgctttccagaaaaacttttttttttttttgagacggagtctcactctgtcacccaggctggagtgcagtggcacaatttcggctcactgcaacctccgcctcccaggttcaagcgattctcctgtctcagcctccccagaagctgggattacaggcgcccaccaccacactcagctaatttttgtatttttagtaaagtcagggttccactatgttggccaggctgatctccaactcctgacctcaggtgatccgcctgcctcggcctcccaaagtgctgagattacaggcatgagccacagtgcccagcccaggaaaacttcttaaagatgtaataataacgcaccttattattttccaagtacttccatagatagtggcccacttctgagtatgaattaaatttccctttgtggcctttgtttttttaatagatcttcatttctggggggacttacaaacaggtgacttctccattcaccagagatgggacattatacactgacctacttccatattcactttccctgcttgattggaggtgagggagaaaaattagtgtataaggccgggcgcggaggctcacgcctgtaatcccaggactttagaaggctgaggcaggtggatcacctgaggtcaggagttcgagaccagcctggccaacatggtgaaaccccttgtctactaaaaatacaaaaattagccaggtgtggtggcacacgcctgtaatcccagttactcaggaggctgaggcaggagaattgcttgaaccccgaggcagaggttgcagtgagctgagtccatgccattgcactctagcctgggcaacaagagtgaaactctgtctcaaaaaaaaaaaaaaaagaaaagaaaagaaaaataagtgtatagaactttattgtttcattgaccgggcacgatggctcacgcctgtaactctagcactttgggaggccaaggtgggcagattggctgagctcagcagtttgaaaccagcctgggcaacatggtgaaacctatctctaataaaatacaaaaaattagcccggtatggtagcacatgcctatagtttcagctacctgggaggctgaggcatgagaatcacttgaacccagaaggttgcagtgagccaagattgtgccactgcactccagcctgggcaacagagcaaaactctgtctccaaaaaaagagaactggccagggatggtggctcacgcctctaatcccagcactttgggaggctaaggtgggcagatcacgaggtcaggagttcaagaccagcctggccaacatggtgaaaccccgtctctactaaaaatacaaaaattagctgggcatggtggcaggcacctgtaatcccagctactcaggaggctgagacagcagaatcgtttgaatctgggaggtagaagttgcagtgagccaagatcacgccattgcactccagcctgggtggaagggcatgacttcgtctcaaaaaaaaaaaaactttttccttaaaatacacctcttggagccagtcccagatacttgggaggatcaggaaggaggacctcttgaggccataaatttgaggatgtagtgtgcctgtgaatagccactacactctagcctgggcaacacagaaagacctcataaataaataaataggccagatgaggtggctcacacctgtaatctcagcactttgggaggccaaggctggcagatcacgaagttaggagatcaagaccatcctggctaacacagtgaaaccccgtctctactaaaactacaaaaaattagccaggcatggtggcatgcacctatagtcccagctactcgggaggctgaggcacgagaatcacttgaacccgggagacggaggttgcagtgagccgaaatcgcaccactgcactccagcctgggcaacggagtgagactctgcctcacacaaataataaataaataaataaatattttataatgtatttttaaaatatagttcttaaaacatgccatgagtaggtttaatttttctaaatcatagaataggatactgaagcccagagtggtcatgtgtcttgcctaaggtcacacacagctaatatatacaagatcatgggtcttctggctccagtctgaggctgtcacaataactagcttctcacttggtcctacctaagacacaggtgtcagcaactctaaattcaagaaattgagattaagactaaagtaatagcttataaacattaattaagcatattaattgcaagatgttaaaccagtcactgagagattaagacattgaagatactggtttctgccttaatagagctaacaatttagtaaaaaagtcgcaaatgagtcaagacttaaataagacttaaagacttaagacaataaaaaaggcatgataaaagggtaaatttaggctggacgcagtggctcatgcctgtaatcccagcactttgggaggctgaggtgggcggatcacctgaggtcaggagttcaagaccagcctggccaacatggcaaagtcccatctctactaaaaatacaaaaattagccaggtgtcatggcacaagcctgtaattccagctactcgggaggctgaggcaggagaactgcttgaacccagaaggtggaggttgctcaagagcaagactctgactcaaaaaaaaaaggatgggggataaatttagcaagaaccctcatcatcccatttacctacagcctaatatgtactaggaacttacatatacaataataggtaaaatctattaagaatgtattatgttttatagttgaacaaattgtgtcgcttaatcaacttagaattcatgtaaatgccacatttgagctctgttacattgagagctctccaggcccagcctaccatgttaagccattgataaacctccctgctactatttaaaacaagatggatacctttctactgtctttaaagaggaagagtacacactgttggactgtatgcactctccgtctctcaagacagtaatctgagggattacttcaatagcagaagttaaaagaagcggtcagttgggtttattacataatctcaatcacatcctgaccaataaaatgcaccaataaagatcagcaaataaaagcaagtgattagaagagcaattttatgctcacgagctctgaattcacaagtgtgagatttcctgtcaagtactctcatgagctcaattaatctctgacccagggtgagaaaataaacatagtgacgcagaggctgcagctcatgctttggaatttgtcagacttgactcagttcccaactccatcatgtcctgcctgggtgaccctcattatgctacctggactctctcagtttccttcacctgtatgtaacacaagagcagagccaccctcaacaaggggttactataaaaatcgaagaacccggcatctctaacaacatccctggcacggagcaatcccccttctccctcagccactggctgagcacccacagaggggagtaagtcctattgtggtaatggttctcatgctttgagatcagacaagtcctttgagaggaacctgaaaaaggggcagcgaacctttggccagaaaaatggaaatatgcacagaaatatttttgactttggcaagcagttgatcagtggttcttgggcttcagtgcccatcagaaacgtagagaacctttttaaaatattgatgtgcggggcgcggtggctcacacctgtaatcccagcattttgggaggccaaggctgacggatcacctgaggtcgagagttcgagaccagcctggccaacatggagaaaccccatctctactaaaaatacaaaattagccaggcatggtagcgcatgcctataatcccagctactcaggaggctaaggcaggagaactgcttgaacccgggaggcagaggttgcggtgagccaagatcacaccattccactccagcctgggcaacaagagcaaaactctgtctcaaaaaaaatagatagatagatagatagatagatagatagatagatagatagatgatagatagatagatgcgtggatcccacccccagaaattatttttccaattggcctataaggggaacagacatccatatttttatggctgtccaggtgatccaatcatggtgagggctaagaaactgctatgtaatctaaaaagaatttagaaaaaataaagctaataaggttaaaagaaataatgcacatcaacaatcatttgaagggagcaatttgagagtatattcatgaaaagcagcaccaagagccagcttgtgttaagaggaatcatggccgggtgtggtgtctcacgcctgtaatcccagcactttgggaggccaaggtaggtggatcacctgaggtcaggcgttcgagactagcatggccaacatggtgaaaccctatctctactaaaaatacaaaaatcagctaggcgtagtgccacatgcctataatcccagctactggggaggctgaggcaggagaatcacttgaacctgggaggcagaggttgcagttagccaagatcgtgccattgcactccagcctgggcaacaagagcaaaactctgtctcaaaaaaaaaaaaaaaaaaaaaaaaaagaggaaatcgtgaggccaggcacagtagcatcgcgccattgcactccagcctgggcaaaaagagcaaaactccatctcaaaaaaataaataaaaataaaaaatacaaatacaaaaattagccgggtgtggtggcaagcacctgtaatcccagctactcgggaggctgagacaggagaaccgcttgaaccccgggaggcagaggttgtactgagctgaggttgcgccactgcacttcggcctgggcgacagagcaagaccctgtctcaaaaaaaaaaaaagaggaaaccatgccaaatgactttaacccttttcttggtagggtttctgaatgactgcccaggctgggcatgacggttcacacctgtcatcccagcattttgggaggccaaggcaggtggatcacttgagctcaagagttcgagactagtctgggcaacatggcaaaaccccacctctacaaaaaattagaaaaattagccagctgtggtggcccgcacctgtagtcccagctacttggggggctgaagcagtaggatcacttgagcctgggaagtcaaggctccaataagctatgaatgcaccactgcactccaaggctggctggcaaggcaagatcctgtctcaaaaaaaaaaaaaagacagaagtgcccaggtgatccaatactccaatacctcttgacttccataaagcagacctccatatgacacgacctctcttgacacttgtggccaagttaatctagcaaccacagtgttgattagtggatctgccacaacctagaggacattcctaggacccatcctttctagcattcagactacgaaagtgttccaagaactttcaacagcaacaatgagctgctaaacgttagcatctacaaaatgaatttgcatagggatagaagagcagttacatggggacaagccctgcggactgtgaggtcaattggccatgtgtccaatatagctcaactgcatgtatcactgatgatgcccaaattgacataaacttcctgaccacattggccaacatgatgaaactccatctctactaaaatacaagtattagctgggtgtggtggcgcgtgcctgtaatcccagctactcgggaggctgaggcacgagaattgcttgaaccagaaggtggaggttgcagtgagccaagatcataccactgcacgccagcctgggcaacacagtgaaactccatttaaagaaataataataataagataaacttctccatgagccccaaactcatgaccaattgaatgcctattcaacatctccacttgaatgtgtagcaggcatctcaaacttaacagggtcaaaaataaactcctgtccaggcaccatggcgcatgcctgtaatcccagcacttttggaggctagggcgggaggatcacttgagcccaggagttcaataccagccagggcaacatggcaaaacttcatctctacaaaaaatataaaaaattagctgggcatgctggcacacacctgtggtcccagctactcagggggctgaggtggaaggatggcttgagcccaggaggtgaaagttgcagtgaactgagatcgcaccactgcaatccagcctgggtgacagagtgacaccctgtctcaaacaaagaaacaaagatttaatgtggccatgatagctgtctttgaatactatgaggcgagcatatgaagggaggtagccaacttgctctgcgtgttgacaaaaaaacaaaggagagcggctctgaacctattttggttctaggagctgcttgattcacagatcattctttgcttcattaaattctgtaatgcttttcttagaagtaagtaaacacaagtagaaattgcatggaaagaaaactgtggctcaatacaacataattctggcattcgaatctaaagtcatgagagtcacataatgcatttccccactgcccagtatctggaagggattcctgtactgagtgtgggctagaagatctcttcctttcaacccactaattctatgacactaaggaaaaggggaagataggagctagcgcagagaaaagagcagacagggactaggcctgaaacagaccagcacggaagtggtcatggaacccagaaatggaacaaggagctacgtcgcaggccacaaaagggctgtaagtactcatgagtaaggggctggaagtgggagaagcaaagtctgaacatctgctgggatgaaagaggggagggcaaccttgggtgtaacaaacgctaccggctggcagggacgacatagcgactgaggggtggtcattcgccacacgtctcaggcaacactttctccaactgcagttctgtgacctggacatctcatcccctgccaggaacgatttcccaccttctccatccaagctccaacaggaaggtaaacccctccccagagatctccatcttggccaacatggcaaaaccctgtctctaacaacaacaaaaaaattagccaggcctggtggtgcacatctgtaatcccagctacttgggaggctgcggcaggagaatcgcttgagcccgggaggcggaggttgtagtgagccgagatcatgccactgcactccagcctgtgcgacagagactccatctcaaaaaacaaaaacaaaaacaaaatccccaccctcacacagcttttccatacttctactccagcacacccaacacgggttcaggatgaactcctgcagcagcgactgctggacacacggactatgtttttttgagatggagtctcgctctgttgcccaggctggagtgcagtggcgtgatcttggctcactgcaacttctgcctcccgggttcaagcaattctcctgcctcagcctctcgagtagctgggactacaggtgcatgccaccacgcccagctaatttttgtatttttagtagagacggggtttcattacgttggccaggctggtcttgaactcctgaccttgtgatccacctgcctcggcctcccaaagtgctgggattacaggcataagccaccgcacccagcctggactacgttttcttttgcttttttttttttttgagacagagtctcattctgtagcccaggctggagtgcagtggtgcaatcttggctcactgcagcctccacctcctgggttaaagcgattctcctgctcggtctcccaagtagctgggattacaggcatgtgccaccatgaaagaaggcagggtgccttctttcttgccaggtgcaaatccattacaataaagtaccattcctgttctcaaagagctcacacaatgagggaggcagccactgtatcgtgcaaataatgctagctattaaacaagccctgattctcaatggcttaattcaaaatcaccagccgaggcagtggatcacatgaagtcaggagttggagaccagcctggccaacacagcaaaaccccttctctactaaaaatacaaaataaataaataaataaaaaattatccgggcgtggttttgagctcctgtaatcccagatacttgggaggaggctaaggcaagagaatcgcttgaacccgggaggcagaggttgcagtgagccgagatcacgccactgcactctagcctgcaagacagagatagactccgtctcaaaaaagaaaacaagaaaccaagaccatgcctattgtcatgctatagtccccttttgggccatctagggtggtgaacaacaccatacatttactcctagctggactttcaccatcttgcggctcggcctcctctcagtcctcctcctctccaggaggcctctttattcagctggagaggcgttgcatggggctggtttttgtgttccagtcgtggaagcgagacaccttttgcaaccacttcctattggccaggtctcagtttcatggtcacctctgaccacaaggttggggtagaaaacatagtccaggctgggcatggcggctcacgcctgtaatcccagcactttgggaggcccaggtgggtggatcacccgaggtcaggagttcaagaccagcctggacaacatgttgaaaccccatctctcctaaaagtacaaaaaattagctgagcatggtggcgcacatctgtagtcccagctatttgggaggctgagacaggagaatcgcttgaactccggaggcagaggttgcaatgagccgagatcacgccactgcactccagcttgggcaacaagagtgaaactccatctcaaaaattaaaaaattaaaaacaaaaaataaaataaaaataaggcactcaaatgtttgctaaatgaataatctaaaccgcagaggatcaaggcagtaaccttggcctcccagacaccgatcaagtagaattggacaccaaagactgagaaagacctgagaaacgtggctcccaaatctcagcatctgaatcaaccaggaaataatgctttaaaaaatgcagatttcaggatgctcaaccccaagagactgtgattctgcagacacagaaatttactatttggccggccacagtgactcacacctgcaatgtcagcactttgggaggccaaggcgggagaatcacttgaagccaagagtttaagaccaacatgggcaacacagcgagacctggtctctaccaaaaatgtattaataaaaattactggccaggcacagtggctcgcccccgtaatcccagcactttgggaggccgaggtgggtagatcacaaggtcagaagatcaagaccatcctggtcaacatgatgaaatcccatctctactgaaaatacaaaaattagctggatgcagtggcgtgcgcttgtagtcccagctactcaggaggctgagacaggagaatcacttgaaccctggaggcagagattgtagtgacccaagatcacgccaccgcactccagactgggcaacagagcaagactccgtcccccgcccctcaaaaaattagctaggtgtccaggtgcggtggctcatgcttgtaatcccagcactttgggaggccaaggagggcggatcacaaggtcaggagttcaagaccagcctggccaacatactgaaaccccatttctactaaaaacacacaaaaaaattagttgggcatagtggcaggcacctgtagtcccagctacttgggaggctgaggcaggagaatcacttgaacccaggaggcagaggttgcagtgagctgagatcacaccactgcactccagcctgggtgacagtgagactccgtcaaaaaaaaaaaaaaaaaacactttagctaggtgtggtggcgtgcacctgtagctcagctacttgggaggctgagctggaaggatcacttaagcctaggaatttgaggctacaatgagccatgattgcatcactgcactcccacctgggcaacagagcaagaccctgtctcaaaacacacacacacacacacacacacacacacacacacacacacacacacaaaaacacaaaattaaatggccaggaatagtggctcattcctgtaatcccaacgcttgggaaaaccaaggcaggaggactgcttgagcccaggattttgagaccagcctgggcaacatagtgagacctcatctctacaagaaaaatattttttttattatagaaaaagaaaatataaaattaaacatttgatgcattgactgagggcctcacacacccttcctctctaagccatcccctgccctcagccacttgtgtttgcttctatagtcatgtcatcagctctctagggcaggtctccagagagtctgtctggtcaccagtggcagtttccacagcagcacaggctttgcaagatgacacttcacccactgagatatggccagcaacaggggagcaaggatttaaccactttctgtgggccagatgcatctggagatccctctcaatgcccatatttagggaaaagtccttcgttgttagcctccaccctgctgctgaccccagatcacctctggatcaggtgtgggcagaggaatgcaaagtgcctgccgggcaccagggggcagcaggacaattcctaggagagtctcagggattgacccatcttgtgcccagctggccacagttcataggctatgccacttatttccactaacgggaaagaggaggaattattcaataaatgataatggggaaaacgagctgtttggggaaaaaatggggactatctcatatcaaataccaaaagaaattctagctgcctttattgttagaaatgaaacaatagctaaaagaaaatggaaggccaggcacagtggctcacacctgtaatcccagcactttgggaggccgatgcaggtgtatcacctgaggtcaggagttcgagaccagcctggccaacatggtgaaaccctgtctctactaaaaacatgaaaattagccaggtatggtggtgggcacttgtaatcccagctacttgggagtctgaagcaggagaatcacttgaaccctggaggcggaggttgcagtgagccgagatcacaccacggccagcctggcaacagagctaaaactctgtctcataaaaaaaaaaaagaaagaaaaaagaaagaaataggtgaaaatactacctttaaaaatccacaattgccaacagccataatgcatgactccttttagactccaagtccaaattatgctataaatacaccaaaatcccgggaaaatactttgaataaaagtcagtaagccagttattggcatcatttaggtaggcagctgccagttcacaagttcagaaagcagatgatatttgagaagaaaagcaaacactcaacaagaaggtgaaaaagcagtttttccctacaaggtgggccctgtctccaggcagccacttcctggatgggctcatttcagctttccactggcagtgggaagggtacacaaatactgacctaaaagcaggaggctaaggcacaaaatataactcaagaatttactacagacccagtgtggtggttcatgcctgtaatcccagcactttgggaggccgaggcaggcagatcgctggagctcaaactcctgagctgtggattacagtgtccttggggcactgttaggttaatctgtagctatgtggcaatatgaagtactttcgagtgataagtaaatagctcaagggggtgggaactacgaggtgactgctgtgtcattttaatgtctctctgggcctgataatttaaaaggactccgcattcctcagatgatgattattattattttctcactatgaggcctcagactttaaaatccctcaaactggcccaggcacagtggctcatgcctgtaatcccagcatttttggaggccaaggcgggcagatcacctgaggtcaggagttcaagaccagcctggccaacatggtgcaaccccatctctaccaaaaatacaaaaattagctgggtgtgagggtgcacgcctatagtcccagctacttgagagactggggcaggagaatcacttgaacccaggaggcagaggttgcagtgagcagagattgcaccactgcactccagcctgggtgacagagctgagcaacagagaaagactccgtctcaaaaaaaagaaataaagaaattttaacaattaaaaataaagaaaagcataatactgtaataatactccaatgaaaggagtagctggaagcagtaagcgcctcaaatcaggatcacctggagcacttgaaacctcaccacccccacccacacacccagtgtttccagttttactgaatcagtccagagtggatgctggagaatctgcatctcttagaatctcccaagtgatgccgatgctgctgctctgagtgctatgctttgagaacagctgccctaaagcacactaatagttgttacacatgcatcatctccaactgcaggtactttaagaatttcccttgagaaactctagccttccagaacagggagcgccttctccatgcatttccgacagcacctgaactggaagcagctcagtacagcagctccaaagaggctggggagccagtctgcccagctttggagcctgctctgacacttgattgttgtgtgagtccaggcaacttaaccactctcagcttaagtgtcctcggagtaaaacagaggtctactagctccttcccttccatcagggaaaccggaaatgaacacctactcaagtcatcaatgggagcgcatcacttcctatttccctgccacctacattttgaaaatgcagggggagaaaaatataaggaggcaggagtcacatctgtaatcccagactttgggtggccgaagcgggaggaacacttgagcccaggagttcaagaccagcctgagcaacaacatagagagccctatctctacaaaaaaaatttttttttattatccgggcatggtgacacacacctggagccccagctactcgggaggctgaggcaggaggattgcttcggcccaggagttggaggctgcagcaagctatgaatgtgtcactgccctccagcctgggtcacagcttgcacaaagcaagatcctgtctcaaaaaaaaaaaaaaaaagttccttgccctgcctgaagttgaggagaccatttgtctacctcaagttattatttgcagaaaccacacccatattccttcctcctccacgtgcccctctccttaagagaaaggccgccaaacaaccaagagaagttcctacacccactgagtgtaccacaatcgaaacaagagtaagcgactcatcctcttggaatcccctaggtcaagcttgtccaacctgaggcccatgggctgccaaattcgtaagctttcttaaaacatcagatttttttttgcgatttttttttagctcatcagctatcattagtgttagtgtatgattagtgttagtgtattttatgtatggcccaagacaattcttccagtgtggcccagggaacccaaaaaattggagacccccaccctaggttgtcccataataaaaggcaatatcaacatgtgggaaagatgaggcggcagaggtcaagaaacagaagatctaataatcatccaagtgagattgaagcccttcaaaggttcaggcttatgtagttagcagacggaattcccccacacacacccgccactcccccaagacggagtctcactctgtcacccaggctggagtacagtggggcgatctcagctcactgcaacctccgcctactgggttcaagcaattcccctgcctcagcctcctgagtagctgggattacaggcgtgctccaccacacccggctaatttttgtatttttagtagagacggggtttcaccatgtcagccaggctggtctcgaactcctgacctcgtgatccacccacctctgcctcccaaagtgcagggatacaggcgtgagccaccgcgccaggccaagatggaaattttagttactactgtcacccgagtctttctccgtttgtttccttgcacaaaatgggtagggctgtgggccctcccagctcaggagccctggggtggttttaagaaggtagaactcctggtaggaaccacctgcatcaagaccatggatcacctctctgaaggttagcgattccagggaccccacctccgagctgtcctcctacgtggaagtgaaagtattggaaacaggggaaagaagctggtcaaagacagactccagtcgtggcggtgcatgtcccagttaaaagcaaatcctggaaaatcttgttcaagaacagggtccccattcataaatgaaaaataataatagtgttattttacccacatgaaacttgccataactaggtaccacgacccacatggacacacagtgagattcccacaaagaggcaaaaggagagccctggtcactgagacaaaagatacagagacaccgggacacagagaggtacaacgggacgtggagttggatcgagctgtctcgtaaggaatatcggaaggggtggggacactactgggagatggcataggtccaggacactaattaggctttggctgagatcagataaaggaaactgttcgtaagctgcttacttaaaaagaaaggaaaaggtgcgtttgagttcaggagactgcgagtcccagagcaggaggcgggagccagcgaagggtgggcgtgtaaggggtgcagtcgcttctcccgctgggcaagagactccccctttcggcagcctgggttccccgcctccccacctcctgctcctcctcccccgagccctaagggcccgcagggcctccagtagcaaagccactggccccgcgtccccgcgtccccctgcgccgcgccccggggcgcaggcagggaccacgcggccggcgtgggggcggcgccacccgcagcagaaagccccggcgtggaccgcgtggcgtaggaaagcgctcccctcgcccccagccgcagagggcttgggcagcatcgggcgcggccccgggagagtgcgtccgcggcgccagcggctgcagggtgacctgtttcgggcggggacactcaccagaagaacacgcgtgagcagaggttcgcgtcctgcagcgggttgggcttcacctcctggtacacgggcagcatcttgccgggcggggcgggcgcgggccggggtcgcgctgatcaggcggcggtggccgcgggctccgctcctggacctcaagcagggatgctggggctccggccgccacgcctgtccgctcggctggagcctgtgaagcagccgcttccgggagccgggcgccggcggcacgccccgtccccgcctctcaggcccgccgcctcgggggcgcccgctacgcgccgccgcctggagcccgggagctgcgcaccgcgtgcgagcgcggccgggaccgacgggtgacgcggcgggaggagacgcggcgggaggaggcgaagctggcgacgccaaagggagcccagagctacgcccaggggtgaggcgagggccgcctgcgccgctggatggagagggtagcagagcgcgcggcaaggaggccgggtccggaggtgcccacgtgcacgaacccgagtgaaactttccgaaattcactatccgagtctaggcgccgacacagaaggtggagcagggaggcgtcggctgtgcccgcccctgcgccgcagaaacgccccctcggctacgggtttgggaagactgggagacagctgcctcgtgctctagcagcccgccccctgggcgcctttcccttctcaggaccaaacgacggtgccatgggaggctcttcaacctgtgagccaaacatttgaccttggacgacagcaaagtttagccacagattatccttgtagagctgcaagacctcaagaaagccgggtaactcgagagtatgacccagatgaattcgggagatggatgaatgctgtcgtcgatgggggcgggctttaggcatctcacatgttgcatgctacggtggacctctgagctttttgctgcccccttagattgggaaaggaatataagaggaaagagagactgcctgatgatttctgtcgtcaagccctaaagcctaacagataacagtggcaaacgacacgtgggttccagaataccagtgatgttcatgtgcatttctgagtgcgtagcctcactagtgtgtgtgtgtgtgtgtgtgtgtggcagtctcacacacagtgtcacgattatggctcattgcaccctcgacctcccagggctcaagcaatcctcccaactcagtttaagtagctaggactacaggcacccgccaccacacccggctcatattttgtaatttttgtagagatgcaaaaatcaaaatcaaaggctccaagttcaaatactgataatttttgaagccaaatgattgtcatggaggtttattttcttcatatttcatgcatgtttgagaatttggttttctttgtaataagatcattttattgttccttgataatttctcactttgttgcccaggctggtctcaaactcctaggctcaagtgatcctcccaccgtggcctcccaaagtgctaggattacaggcatgtaccaccacgcccgaccaattatctcacttttaattctatcagtgccccattcaaggttatccttactttatagatgaggaaggtgaagctgaaaggcagaacttgtccagtcttagagccaagaaaggataaaacatgatttgcaataagcctatgtctaagcatggcctgtctccctggtggatggccagtgtgcatgagaagtgcccagaatatgctggttgaatggctgtaggaatgaatgaacaaaatcttgttccaagcttgtgtactcccacctctaagtcttcagtcatttctgtggctaccttaacaaggtcagcagctgctcttcatatccaccctgaatgaaaaaaaatgaaaggctccaagttcatggtgcttggaacaagatcattttattgttccttgataatttcccatgtatatttgctaaaatagtatagttaatagcttttaaagaaagccttacacaaacacatatttaaaagtcaagcacaggctagccagcatagtgaggctctgtctctaccaaaagttttaaaaattagcccaggtgtggtggcgtacccttgtagtcccagctactcgagaggctgagacaggaggatggctttagcccaggagttccaggctacaaggagttaagaaggtgcccactgggctgggcacaatggctcacgcctataatcctagcactctgggaggctgaggcaggtgaatcacctgacgtcaggagttcgagaccagcctggccaacatggtgaaaccccatctctactaaaaatacaaaaaattatctgggtgtggtggtggatgcctgtaatcccagctactcaggaacctcaggcagaagaatcacttgaacccaggaggcggaggttgcagtgagccgagatcatcccactgcactccagcttggcaacaagagtgaaactccgtctcaaaaaaaaaaagaaggtgccactgcactccaggctgtacaagcccataatcccagcactttgagaggtggagacaggaggattgctttagcccgggagttctagaccagcctgggcaacatagggagacctcatctccactaaaaatgtgaaaattagatgggcatggtggagtaagtctgtagtcccatgtaacctggaggctcaggtgggaggattgcttgagcccaggagttctagaccagcctgggcaacaaagggagacctcatctctactaaaaatgtaaaaatatgatgggtgtggtggcgtgagtctgtagtcccagctggaggttcaggtgggaggattgcttaagcccaggagttggaggctacagtaggctatgatcacaccactgccctccagcctgggctaaagagtgagactctgtctcaaaaaaaaaaaaagtcaagcacataagaatggcaaaatattgataatttttgaagccaaatgatgtgtcataggggtttattttcttacatttcatgcatgtttgagaatggttttctttttggagatgggctctcagtatgttgcccaggctggactcaagctgctgggcccaagggatcctcctgcctcaacccctccaagtacctgggattgtaggcactcgccagcataccagctcatgtttcagaatttctgtcacaaaaaggaacacaatattttaagttgactactgtgggaaagctatgatcattcaataacctacctttctgatagctctttctcagataatataagctataaaccaaaatagtcagccttcacctgatttacagtgccctttgaaacttcctaagttttctagcccagtaaatgctgagctaccagttctacttccaagctagagaacctgtttactaaagttagaagtctagtgacttcctctgtcagactgtcccagaatgctctccctacccccaacaactgtgtaagaaccgtcattagccatctccaaattgccaaagtgctcagtcccttcggctcctgcagaggcttatttttttcttaattaagatcttttggaacttcttaacattcttttctgaacattaacaatgtggtgtttggaagagatactatagagcagtgtctgactgcagagaggagtggatatggaaccagggggccagggctttatatcttttcacttgttacctaacctttctgacccttatttttctcaggtctaaaatggggtcggggcgggcgcaggggctcatgcctgttatcccagcactttgggaggcggaggcagacagatcacctgaggtcaggagttagaaaccagcctcgccaacatggcaaaaccccctctctactaaaaatacaaaaatgatctgggcgtggtggcatgtgcctgtaatcccagctacctgcgagactgaggcaggagaattgcttgaaccagggagtcagaggttgcagtgagccgagatcatgccactgcactccagcctggcgacagagcgagattctgtctcaaaaaaaaaaaaaaaaagataaaaattagccaggcttggtggcatgcgcctgtagtcccacctacttgagacgctaaggcaggagaattacttgaacctgggctgcagaggttgcagtgagccatgagccaagagctcgctgctgcactccagcctaggtgacagagctagactccatctcaaaaaaaaacaacaacaataaaatggggtcaggcagggcatggtagctcacacctataatttcaacattttgggagcccaaggcaggagcatcacttgaagccaggagttcgagagcagcctgggcaatgtgatgagatgccgtctctacaaaaaataaaaataaaaaataataataataatagtaataataatgttttttaaattagccaggcatggtggcacacacctgtagtcctagctactcgggagggtaagatgggaggatcacttgagcctaggagtttgaggctgcagtgagctctgattgcacgactgcactccaacctgggagacagagtgagagaccctgtctctaaaaacataaaaatacatgtaaaaacaaaatagggatcagaatccccactcttccttcttcacaggattattgtgagtctcacaacttgtgaatacactctgaaggcaatatacaaattaaaggatgggggttttttcccattcattcaataaatcgttagtgaacgccttctggatacatgacagctaggccagggaatgagcctgcaaagacgaggaagatgtcttcttttttgtttgtttgtttgtttgtttgtttgtttttgaaacagggtctagctctcacccaggctggagtgcagtggtgcaatcttggctcactacaacctcccgggctcaagcccatcctcccatctcagcatcccaagtagctggaactacaggcacgcaccaccatgcccagctaacttttgtatttttttggtagagagggggttttgctgtgttgcccaggctggtctcaaactcctgagctcaagtgatctgccagcctcagcctcctaaagtgctgggattacaggtgagagccacagcacccagcctaaagatgtcttaagaataggcatgggcaaggacctcatgtctaaaacaccaaaagcaatggcaacaaaagccaaaattgacaaacgggatctaattaaactaaagagcttctgcacagcaaaagaaaccaccatcaaagtgaacaggcaacctacaaaatgggagaaaatttttgcaacctactcatcagacaaagggctaatatccagaatctacaaggaactcaacaaatttacaagaaaaaaacaaacaaccccattaaaaagtgggcgaaggatatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagagctagaaataccatttgacccagcaatctcattactgggtatatacccaaaggattataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacactgcatgttctcactcataggtgggaattgaacaatgagaacacatggtcacaggaaggggaacatcacacaccggggactgttgtgggtggggggaggggggacggatagcattaggagatacacctaatgtaaatgacgagttaatgggtgcagcacaccaacatggcacatgtagacatatgtaacaaaacctgcacgttgtgcacatgtaccctaaaacttatcaagtataataataaaaaacaaaataaaataaataaatgcacagtttagctgggggaaaaagaaaagagacagggtcttatgttacccaggctggtcttgaactcctgggctcaagccatcatcctgccttggcttcccaaagtgttgggattacaggcacgagcctccaggcctggccataagctttctttgaaggcttctctagagagcgtccttttcttgtctcctggtagttcttggtagtgccatgcaggccgctgtctatggctgtgagtataaaggcccgcaggtgaggggacgaggcatgggatgggtgctgggatcctgggctccttggccaagctatatgctctgggtatgactgcctcagcccctggaaagggcacctttctgtcactcactcaaaggtgttctctctggcatgaacacagtggccacctccctctcatttttcggcctgcttcaattaatatgtgacttttgacttccctgtctacaattcccttctccactaagtgaggctaaagctttgcttttggtgaaacatgacagcattctactgctaattccatcatgccacctgtaagcctaacccttcctctggtttcctgtgtgacatgctatatgatactgggccagtcacttcactgtgttggcctcagtctcctaatttgtagaatgggggacaggggttgcattagacctggggatactatgattatttctgaataatgccttttaaccaatcgaatgttgccttttgcgatactacctatggcttgcctgggcacacccacatgtgcactgggggaatgggggggatccaccaggaatttgtgccttatgcaggggaggggcctggcctcttcagctcatccatggtagccctggtattcaactgtgagggggaaacctgcttggagaacccctctctttgccaagagctttcctttcgcttaataaattctgcctgcctcacccttcaaaaaaaaagaaagaatgacttgtcaaaggaaaaaatattagggccacttcaagctgggaactgctcagggcaaatctgcctcccattctattcaaagtcacccctctgctcacagagatagatgcatattctaattgcctcctttggagagacttatcagaaactcagaagaatgcaaccatttggctgagcacagtggcctgtaatcccagcactttgggaggccgaggtgggtggatcacctgaggtcaggagtttgagaccagcctggccactttggtgaaaccccgtctgtactaaaaatacaaaaaagtagccgggcgtggtggcaggtgcctgtaactccagctacctaggaggctgaggcaggagaatacttgaacttggtagtttcactcgtgtccatgtaaagagaccaccaaacaggctttgtgtgagcaacaaggctgtttatttcacctgggtgcaggcgggctaagtccaaaaagagtctgcgaagggagataggggtgaggctgttttataagatttgggtaggtaaacgaaaattacagtcaaagggggttctctggcaggcaggggtgggggtcacaaggtgctcagttggggagcttttgagccaggatgagccaggagaaggaatttcacaaggtaatgtcatcagttaagacaggaactgggcatctggacgtgtacatgcaggtcacaggggatatgatggcttagcttgggctcagaggcctaacagatagaggttgcagtgagctgagatcgcaccaccgcactcaagcctgggcaacaagagcaaaactccatctcaaaaaaaaaaaaaaatcatgaataacttggccaggcgtggtggctcacccctataatcccagcactttgggaagctgtggtgggaggattggttgagcccaggagttcgtgacccaacctggacaacatagtgaaaacccatctctaccaaaagaattaataaaattagccaggaatagtggtggaatcccagctacttgggaggctgaggcaggaggatcgattgagcccaggaggtcaaggttgtagtgagttgtgattatgcccctgcactgcagcctcagtgacagagtgagaacttgtcttaaaaagaaaaaaaaaaaggaaaagagaaaaaaataccaatggataacttattttaaggagggatgagaagatgttaaacatgaggcctgcagtggcagaccatccacatcaatttttatggaaaaaaatcatcttgtttgtgccctaattgaagaagaccaacaattaacagcagccaacaccatattaacaatagcaaacaccacagacgtctcaattggttcagcttacacagctctgactgaaaaattaaagttgagcaaacttttcactcaataggtgtcaaaactgctctgcccagatcagctatggagaagagcagagctttcagtggaagttttaaacaagtgagatcaagatcctgaagtattttttttcaaagaattataacgggagatgaagcatggctttagcagtacgatcctgaagacaaagcacaatcaaagcaatggctactgagtggcagaagcggtccagtcacagcacaaacagagcagtcaagagcaagggtcacacaacagttttctgaaatgctcaagatattttgcttgttgatgttctggagggcaaagaatgataacatctgcttgctatgagtgttttgagaaaattagccaaagcgttagcagaaaaatgcctgggaaagcttcaccagagtccttctccaccacgacaatgttcctgctcattcatctcatccaaccaggacaatttcccaagcgtttcaatgggaaatcactagtattcacattacagttatgatttgatgccttctgacttgtttttgcttcctaatcttaaaatatatttaaagggcactcatttttctttagatattactgataatactgtatggttgaattcccaggactctcaatactttttttttcttttgaatcagagttttgctcttgttgcccaggctagactgcaatggcatgatctcagctcaccacaacctccacctcccaggttcaagcgattctcctgcctcagcctcctgagtagctgggattacaggcatgcaccaccacgctcagttaattttgtatttttagtagagacggagtttctccatgttggtcagactggtctcaaactcccaacctcaggtgatccacccgcctcagcctcccaaagtgctaggattacaggcgtgagccaccacacccggccaggactctcaattctttagggatggactaatgactggtatcattgcttacaaaggtgtctcaaacttgatggagcttacactgagaaataaagtttatattttttatttttatctgttaagtccatttttttcatgaacttttttttttttttttaggctagtcaagtgaagcagtgggagtggaaaaggagcaaagaaatctgtaactggttgtgattccatgaactttttgaaatccccttgtattggcttccttccctcttctgtcttacttctctactccctacaagtgttttctgggatcacctccaaataaactacttgcaatctaatcctgtctcaagtctgctgctgtgggaacccaaactaagacacctgcaaaaaatatccttccaattactgaaaaatatgttcacttgcacccataaaagtgtttgctaataccgtagacccttggctgtacaatatggtagcagtatccacatgagcattttgggacttgaaatgtggctggtcccagttgagatgttctggaagtataaaacacactgacttcaaagacagtgtcaagaaaaatgtgtttaacgtctcatgaatgattttttttacatggattacatgttaaaatgataatatttggacacattagttaaaaacagaaagtcagccccccaacatttccaggtagagaacctatcaaaggagactgaagtgagaagaaaaatagagtcacagaagtgaagaaaatgtt

SEQ ID NO: 1018 - DNA, 37003 bp, Homo sapiens
cccccatctcaaaaaaaaaaaaaaaatgctgtaggtgaaagaaccatgcaacacttcaaagattgataaaatatttacaaaatgctctcatttttaaacttataaggcatactgaagtagtgtatcaggcaagtgaaagcctcactagaagaaggaaagactagaatttaaaaaatgttttaacccataaggtcatcctggacttaccccaaggacaagaatgtcacactgtctttatccaagtctcaaaggtaaatatcacaattatttacttagatccctttaaaagtgatcatttctttttttttcttttttcataaataattacaagaacaagcaaataatttctccttttattgctgaggctaaagaaaagcagtaaaattttattgggaaacatttgagcttttcattacatatttgcaattgctatgtatgtgcacataggttcagtagtatgttgcactagcatttggaaactataatctgtggaaagtgtgacactcctagattggcagatatttgcgtgtttgaattgtgatacgtgaccactggtcttatttttgtgtcaaaaggatgatcttttccaataaagtcttaagtctttaaaaaaaaaaccttaactgctgaatgtgcctcaattaatataatagataatattcttgagagttatggaagatggatgtaccagaaaacttccctctctcctcctcttttttgagacagggtccctgtttccgaagctggaatgcagtggcatggtcacagcgtcaaccacttgggcttaagcagtcctctcacctcagcctttccagaggctggcactacaagcatgtgtgcctggctactttttaaaaaattttttgtagagttggagtctatgttgcccatgctggaggacttcctgttaaggaaaatccttattaaatgtttttctagcaagaataaatactctcattcatttttatttgtaggtactgattttcataaatatttgtgattgatgttgcatgtaccttttcaagaacttttctgataaagcgctagattccttagtgtaataatactggtatagccaaggtgtgtgttaattaactggctctgtttccatttcaaatgataatttgagatgaaaatagatggatttcagaattgattattgatgtaatagaaacaaggtgtagctgtttgggcactttttgtttagggtttatttttactgctgtgttggcaaaatactgaaatgcagaagatggatgtgtcccagaaaagaagatggtaattatggggaagcatctgctgtgatatagttatgtttgtatgtgttacatctatcactgtaataattgtaagcaaagacagagagttttgtcttcattttgtgatggatggctctttcctttgcagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatggtaaggggtttgtttctttttggaacgttgtctcaactttgcattggctttttaaaactgccagtcatgaatattataggttagattctgtacattgttaacctctgccctatgattgtatattattgtgagtgaagcatttttagttgagtccgcaaacaaagccatataattttagtttgtttatccccaccctcctaattctttattgttcaaaatttcttacatttttgtttttagttgggggtaggatttggtaaaagataaaagggtgttgtattacttaacaagatggacaaatttgtattcattgtttgaaagggagaataagcatttctcgttaagtgtaaatcttagaaacatgggcagttttcagcgatctgaaagtaataaagttgattgtatctgtgaaggttttattagtgaataagagatttaatctttaaatttgctgagataaaacttgtcagcctccatcctttttagtgcaagtgtagctgtatctctgtttctcttctttgtaaggtgcattattaataaggaaaatatccaaattctttgaaattttaaattgaaaattagtgtctctggttaattgcaaagatgatcagtagccaagtaatttcttctgaactacctaccttttcaaaatcttcaggaattatttcctgtgacttttgtccttttatatgtaacagtccttggttgagaacatgggcctctttggagtgttatagaggaccacactatccttaaggatcagacttgctatggaactaaggcactggatcaggaataaggggattggccatagtgggcccataggtaaacgtgagtcaaactttggggctgtaatcaggcatatggcaagatggatcaaaacaattttaacttggttgcttaatacagttgccctcggtatccatggtggattggtgtcaggacctcccacagtaagcccctcatataaaatgatgtcatatttacatataaacctatgtacatcttcccctttgagccatctctagattaacagtacctaatacaatataaatgctaggaaaatagttattttactgtattgtttgggggataatgacaagaaaaaaaatctgtacatgttcagtatagacccagttttttcttccttgaatattttccttctacagttgcttgaattcattgttgcatgtggagggccaactgtatattattttaagtatctgacttcccccaaaacaaactcagtcatattttaagattccaagcaaaatttttaaatgtagtgtgattttagaattgtatttgtttacttgagcgtttattgactcccttgctttgtggcaggcactaaagaaacatttttcaatgttataaacgatattaaagttggtctgactctcctttgcacagaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttttttcttttctttttttttttttttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaattagcttttttgttttgttttgggtgtatgtttagcatttgtcattttcattgagtcattgaatttctactcattatccttcaagtaccacaacagtcaaacttaagaccaagcatcgattacgattttgcacacaatttttaatttatgccttattttgcaaaacggagctggagtttagggctacacttaaaattttttcttgacttataattgttacaaaatattttaaaatacagaaaagtataaagaaaatagtcatctatttcttaggctttttttttttttttttttttaattgagacagggtcttgctttgtcacttaggctcaagtgcagtggtgcagtcatggctcactgcagcctcaaagtcctcgactcaagtgatcctcccacttcaggcttccgagtacctgagactataggcatatactaccacacccagctacatttattttaattttagtagagacaaggcctcgctatgttgcacaggctggcctcaaactcctggccccaagggatccttctgccttggcttcccaacgtgttgggattgcaggagtgagctacagctcctggccctttttgagttttaattgaaaagcagcgttggttttttgtgacctgatttcaagtagagtatctttgtagttagtgatgtttgttttaaaacgctggccagcactactgatttttactaacaacatatctggtaatattatatgagtaaggggtgttagaatgtaggtaggagaaaatgtttttaaggtggaagaatgtcaaaatttgctccattttctcagaggtaattaagtataaaagtatgatattgaatggccttcaaatgtgtagctttcatatatggttgaaatgaaattccatttctgttaaaagcaaagtattgttttagacataacttgtaatacaatcaaggaaccttgggagtggagttataatactcgaaaactgaggtacaacttatttgaaagtaattgctgcttttgcttgtttagctgatacaggtatatccggtcttcagcagtatgttaaatactgcactgtctcttgattaaccttttcttttttttctttttctcttttttttttttgccgagagtctcgctctgccacccaggctggagtgcagtggcaccatcgtggctcactgcaacctccacctcccggattcaagtaattctcctgcctcagactcctgagtagctgggattacaggcgtgcgccaccatgcccggcttatttttgtatttttagaagagatgaggtttcactgtgttggccaggctggtctcgaactcctgaccttgtgatccacccacctcggcctcccaaagtgctgggattacaggtgtgagccaccgcgcccaaccttgattaaccttttctacagtctgctcaagtgagtaaaaaatcctatacgatttttaatttgcatgtgattaaacattttggtgtttgatatatcagatactgtgtttggcttttgttatgtacatccttcaacttgaccaatttaaacaaaaatgtaatttctctgtcctgttggtgtaatgtaatcaagagtttgtgataggaaattaatttttcaaccagtgatacaattttatgactgaatttaatatggacctgttaatgtgacattttcatgtttctgttgagtctgccttgatgaataactcagagcacttattctgtggtacacagagtcagtatttctcatttctggaattggatgctttattttctggtatgcctgtgataagagaggtgatagagtggcttctgcatctaattggtttgaatcctggtattacacttaactgatttgggcaaatgtatcctcgaggctcgatattttgttttgtttttctcccctgtaagagcactcactgctgtcttagcttgggctgctgtgaaaaaaaaaaaaaaccacagactgggtggctttacacgcgcattcctcactgtttttggaggctgggaagtctaaagatcacagtgccccctgattggtgccccagtttggttcctggtagtcctcatacagagagcgcaatagatgtcagtttccttggctcctcaggtgtattggatacaactgactactccagtttttgagacacttttgcaaaacaatgtaaagccattccttctgacaacttactttctcagatgttccctctttcatgagtagttatgccctgtactcaaatcattgcctgctgctctacgtcactgtcttgggagttcacctatccctgtggttatagtgaacactttcataatcccaggtaatgtcattaactgatctggacccatcatggggtggctgtgctgagggagtgttgagctagcccctagtggtaaggagtacactgctgaccttcatcctatggcaattccactttggtgattcactgttcccctcatggagaccaaggaggaatttgctgcatggtaggttggtgaatccagcctgtagcaaagacctggcttggactcctgcaactctttatgaaacttaaccaagaatgattgcatcttccagcgggggaagatgctgagaaggccccttcaggataaactggctccatagcactgctgtaatgatggctcctcatgagtaagcacttggagatttttgtggcttcctgcccactcaccctgctcaccagtccaggtagtttatgatttgagatctagatgtaattttattttatttctttttttttttttgagatggagtttcgctcttgttgcccaggctggagtacaatggtgcaatctcggcccaccacaacctccgcctcccaggttcaagcaattctcctgcctcagcctccctagtagctgggatttacaggcatgtggcaccacgcccagctaattttgtattttagtagagacagagtttctgcatgttggtcaggcaggtcttgaactcccgacctcaggtgatctgcccgcctcggcctcccaaagtgctgggattacaggcatgagccaccgcggccggccaagacataattttaaaaattatcttccagctggccgggcgcggtggctcacgcctgtaatcccagcactttgggaggccgaggtgggcggatcacaaggtcaggagttcgagatcagcctgactaacatggtgaaaccccgtctttactaaaaatataaaaattagctgggcatgatggcacgggcctgtaatcccagctactcaggactctgaggcagaagaatcgcttgaacccgggaggtggaggttgtggtgagccgagatagcgccactgcactccagcctgggtgacagagcgagctccgtctcaaaaaaaaaaaaaaaattcctcttctttccttcattcattattcttagtctctgtctgtctcatatgagtagataatcatatgagtagctataatgaggactcctcaggggacagattctgtttggccactcagcagaagcatgcaattaccttctcaagattggctcctaaacttactctagatagagccttcaggcaggaaactctatatcccttggctccagaagaatatattcatactcattcaaatgtgctaggcactggccataaagaatattggtgttcattcataactgcctataatgtgctaggagctgtgcataaagcagtgtaacaggatcatcttggaaagcttatgtagtcagtagaggagacagataaactaggaattacatggtaagttgaaagaggaagttaggggtaagatgctgcaccaaatgcaggagattggaaggtttttctggaagaagtgatgtttagggggagtttcagaggtaaatttctggtttggttaacagaagatagtttcactgctcactgagattacagaagaaacaggctggaagagtttggtttcaatatgtcaaatttgatgtgcttataggaaattttatttatttgagacagtttctctctgtcgctcaggctggagtgcagtggtgtgatctcggctcactgaaacctctgcctcctaggttcaagcgattttcccatgtcagcctccccagtagctgggattacaggcgcacggcaccacgcccggctaatttttctattttatggtagaaacgggatatcaccatgttggccaggctggtgtcaaactgctgacctcaaatgatccgccctcctcggcctcccaaagtgctgggattacaggtgtgagccaaggtgcccgacctgatgtgcttgtaagaatttaaatgaagagggtcagtcagcttaggagacgaggttagatgtaaggatttcagacttgtcagtatacaggtggtgattgatgccgtaggaatgactggtattacccagggagctggtgcaaagtaggagccttggggaacatgttaaggggatgtgagagtaagcccacaaagactcagaagtggccagggagtaaggggaaaatgggatagaatagagcaaaagccacgggaggcattccttgaattccttggactcagatatgttaggggacaggaaacacattgaagacaactgaagagacttcagtgtgctgctgagttcttagcagagtagacagctgatttcaccactattccagaccctaaagatttctcctgaaattgcactgttatgcaatttttttccttctctattgccccacctctggggcctacactctttaccttctctgatttatctgacccatccgcatatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgccgcgggccgggctcgcactcgagattctcgcccgtgggattccagtcctgagctgaacgagagataagtctttgtcaccccccagtctttactgtttcgagaaaccctaagattttttaaaaaaaagcccaagacgtcaagtcggggaactccaacattggggtgtccagaaacactggggtttcaggcgctctgtaaatgcgtccgaggtccgcggttctgcccgcaagcccagaccccggcctcacttccgccccgcgccccgcgccccggcctcacttccgccccgcgccccgcgccccgcgccccgcgcgcctccgcccgcccctgctccggccttgcgcctgcgcacagtgggatgcgcggggaggtggtgcgcggggaggtggagggcgaggggcggggctacctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggtgagtggccggcgggagccgcgcagagtccgaggcgcctgctgcttcggcaggagcgccgagggccggacttgtgtaggagaggggcgtatgtggaggaagccggtcaggccaagccgcgaggagccgcgggatccctggaaccctgcggctcccgcgttccctgacctggtgctacagccccaccctctcctctcccgatgtgcgcactccgtccctcgtgcttggattggctcccggggtagagccatcgcgtggcctgcctctcccattggttggcgtagggaggtgttctcctccggggcccctgattggccggctccgggaggcgccatcggtaatgcctgcggcaggggcggaactgctaggtggtctgagcccggctttgggctggggtcgggctgtcacacaatggctagaagtcgtgacttcgtctccttcgtgccgcatggttttcaacgcccttgacccgccggttccttttgtttgggaagcatggggtcgcatccagtccttcggatttggggaaatagaagggctacagcggcgtccctaggccgttctggaggtcgcctgtccagccctcggctgctgcgagttgtggcacccaccttgacctttgctcagaccagcaggtgtaggaacgtgtgggaggagagggcactgcctcctcgcgtggccttgccaaacagggtcatgaggctcccctgctcgtaggtggttcccgtattacccgcaggcttgtgatgtccacgctctccgcctttctattgtaggttccttcaatggtgccttagctgctgttcctgtccaggacctgggctccactgtcatcaaagaagtcttgaagagggccactgtggctccggaagatgtgtctgaggtcatctttggacatgtcttggcagcaggtaagtctcagtgattccaggagaagtcaggcttattagaaacagcccataaacacacacacacacacacactctcacacactcacacactctctcactcactcaagttcttgcctccttgcttttgctcagagttccctctgttatgattcctcctgttggcccccttcttccagccctgtcagtagcttctatccagcttgagactcagcttcttggccaggcagggtggctcccgcctgtaatcccagcactttgggaggcggaggaggaaggatcacttgagtccagaagtttgagactagcctgggcaacaaagcaagaccccgtctctacaaaaaataaaatagccaggtatgatggcctgtgcctcccagctactggagaggctgaggtgggaggatcacttgagcccaggagtttgagactgcagtgattgtgtcactgcactccgtcatgggtgacagagtgagaccccttctctaaacaaacaaaaagacttagcttcattaatatgctttttgtgaatgaacttagaccactgacctacaccacctacactgccttttcttttccttttttttttttttttttttttttttttgagacggagtctctctctgtggcccaggctggagtgcagtggcgtgatctcggctcactgcaagctccgtctcccggtttcacgccattctcctgcctcagcctcccgagtagctgggactacaggcggcccactgccttttcattcttacgaagcagggccggccgggcccggtggctcacgcctgtaatcccagcactctgggaggccgaggtgggcggatcatgaggtcaggagatcaagaccatcctggctgacacggtgaaaccccgtttctactaaaaatacaaaaaattagccgggtgtggtggcgggcgcctgtattcccagctacttgggaggctgagacaggagaatggcgtgaacccgggaggcggagcttgcagtgagctgagattgtgccactgcactccattcagcctgggcaacagagtgagactccttttaaaaagaagaagaagaagcagcagcagggccagcctgacgcataggaaagtatgcctgctcctccttactacctcaaagtgtcactcattcaacaaaaatgtattcagttcctcctatgtgccccatactgtgcttagtgctgggagtatggttccaacaatacaggtaagttccctgccctcttagggctcagttctgagcttggaaaataggtgccacatcatgccccttgcaaatggggcatatcactccccagaggaatatagctgagtcctgagagtgcccccatcttctgattctttgggtttgaacactcgtaattaattaattaattattattattattatttaaagagacagggtctcactctgttgtccaggctggaatgcagtggtgtaatcaatcgtagcccactataacctcaaactcctgggctccacggtatcctcccacctcagcctctggagtagctgggattacaggagcaggccaccacacctggctaattttttaaatttttttgtagaagtggagtctgtctgttgcctgggcgtgagtgcaatggctgttcacaggcacaatcatggtgcaccatgcccttgaacttctgagctagctgggactaccggtgcatgtctactaagtttaaggcttttaaagcactgtgctaaatgctttcctttcattacctcatttaatcttcctcacaagtctgttatatcctattatcttcattttacaaatgaataaatgagagtttaagaggttaaatgacttaccagggtcacagtttgaagtggagctagcacttgaacttagatctgtcctattccttgagccagataccttctacaatcatgtaacaaatgtttattgagcacctactttgtgccaggcactattttagcagctggagataagcaatgttcatatcagatagaaattctcattctcatgaagctcgtagtatgctaaatgctagcattattaattgtgttagcacctcatttctttctttttctttttttgagatggagtcccactctgttgcccaggctggagtgcagtgacgcaatcttggctcactgcaacctctgcctcccgggttccagtgattcttctgcctcagcctcccaagtgactgggattacaggtgcctgccactgtgcccagctaatttttgtatttttagtagagatggggtttcaacatgttggccaggctggtctcgaacttctgacctcaagttatccacccgcctcggcctcccaaagtgctgggattacaggcatgagccaccatgcccagccctgtacctcatttcttctttttcttttttttgagatggagtctcactctgtcgcccaggctggtggagtgcagccgtacaatctcggctcactgcaacctctgtctcaggttcaagcaattctcctgcctcaacctcctgagtagctgggattacaggcgtgcaccaccatgcccagctaatttttgtatttttagtagagagggggggtttcaccatattgtccaggctggtctcaaactcctgacctcaagtaatgcgcccccctcccccggcctcccaaagtgctgggattacaggtgtgagccactgctcacagcctgaggcaccgcactgggcctgtctttttaatatgtatatgatcctgcatatgttttcagtctcaagtaaccttacccgtttttagtttccagcctaatcccagattgataacattgtgatgaatataatctctaagtttttatcagcgacttatttgctagttcttccccacaaactctccaaggaagggtggtaggtttgagtatatctgaaactgggaatagagtaaccactttataaacatttaccattgactctgataacagacaatggcgattgagaatatttgaaacttttaactccattctcttctgtgctactttaagtaaattatgtatttcttcccaactaaaggaagtcccatagttgaattatgaaaagatatttgtgtttcagtactcagaatgagaaaaaaaggtatttgtgaattctgagtttgtatatattttgttatataaccatttaagcatagtgtaatgaatactaagcaagaacagaactgcttattatcaaaggttttcctttttaagtaaccctttttcttctcaagtgtcttaagccatgatcttgggagcaaatggccctagttagaaacactgataatgcctaggttatatcctgtgtttattagacataggtttgataatgcttatttaagcacccccccgcacttttttttttttgagacggagtttcgcccttgttgcccaggctggagtgtaatggtgtgatctcagctcaccgcaacctccgcttcccaggttcaagcaattctcctgcctcagcctccctagtaactaggattacactcatgcgccaccacgcctagctaattttgtatttttagtacagacagagtttctccatgttggtcaggctggtctcaaactcccgacctcaggtgatctgccctccttggcctcccaaagtgctgggattacaggcatgagccaccgcgcccaactatttaagccatatcaaaagatgaggatgacacttctttcttaatgtattaatgacttatttatggaggagaaagcttatatctatgaaatacctacagagcagcacaaggcagtatatattcaagggctagactgtgacaggtggagagtgtatacaggcctttttgcctccagtgggcacttacttgacctgtaggctttcagaagtggcaggtaacccaactggcaattttccacacactttcactgtgacattttgtctttctccttgattgctaagagtcctctgtgttcctctttctaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggtaaggcctctctgatgaggtggctttcactgacctcacactgagaaactcatgtctatgccagaacagagtaaacagatgcatagcagagctggaaccaaacagtgaacaaataaacagaaatgacaaccttgatccctacttgaatgtgaagtattcttcagtttgggtgggaaatccgggttgataagaagtttatcaaccagtgtgattggaaccgaatatactttttctaaactattaatgaagcatgtaatattttctgaattaaattcatattagttgcttgatgtccttggttttaaatttctttcccattgtgagtaaaaggcaaaaaacagatgttgccacttaccttcctgcacatgacaaggagatcctggggaccagactttttgaccttttcagggtatagaacatgtaaaagaggaccaccaagtggtgcccttctccagtaggtttgccaggcatgatttgtttcaccaagttccatacctcaaactggcatagtggttgaaagaaaaactataccccctgcttcctactgatgcagctcaggggctgaggtgcagattccctagatagaagctgattcagcccagccattgctgaggttcaggaggaggcaggctaaaggtaacaaaaataatcggagtgattttgatgggatgatactgacatctgtgtagtactttaccaggtgcttttgtacatgtgttcacaacagccccatatagggtagatgataccattcccagtttacaggtaaggaaactgaggaccagagccagcattcaaatacaactcttccgactctaagtccaatcaatgactctttccattctaatatacctgctgttgagttggtgagagttaagactggccgctactcagaaatccctccccatcatttagttagcctgattattctcactgtagacattatgtcatccattgaaataggtaacacattgttagctttacttaagcccttagaggatttcttcatttaacagataattaattgcctcgatggaaagaataaatggaattcttaaggaaacaggacacagaatgggtaggtttgagggagaattgaaaatgggtaggtaggagagtaatcgttcccaacaataggaaagatgaagtctgctaattccaggggtctttagaccttggcctggctgaggacctagaactggggagaagggctgcaaaggggcctagatgaagacttaggaaatactagatagttttgagttgtattctggggagaagactaattgcaactaagcctaaatccatttttatttctgacttctaggctcctcacttggcttacttgagaacaggagtaaagataggtgagatgccactgactgacagtatactctgtgatggtcttacagatgcatttcacaactgtcatatgggtattacaggtaaggcagacatggctgaaactgtattagctttaaaaaggttaaaaagaccatatactaatctgcttcttaggtgctttcgtccttatggccagagactgtcttaaggatttttatatctcttctttgattaactgaagtgaagtaagtattctcttctttgtgaactcttgattatcagagaatgttagaagtgggaagtacctcagagttcttctggatcaacccctcattttaccaaatgaagaaacagggcccacaaatagtgcttctgtggcagaggtagtgacagagataaaccagttgtttttttggtacctagctgtactttttgtactacacaattgggttattggtcattcatgctgaagggtcctgtggtctaagtttaatggcaaagcaactgggaaatcaaaagcactcttgtctttagtatacatgtaaaacttaagaaacagaatagacattttagagttaaagaatcaaaccctgagaagttaagcaccttgctcaaatgcatgcagcaatggctctggttttatgtaacacataaatatgtgaaaaaggtaatggggaaaagtacaagattccaagagggaactgtgtgcatgaatgctaggaaggaaggaagggcttagggatatgggaagcaatgagaagctcaaggcatcttgaccacttctcgacttacagccacaacagagaaggctataaaaacacaggcagacaatggaagacactgtgtgaccaactgcctcaaccataactagaggtggtcattaaaaattcagatcccgagccctttccaaggtgtactgtggattgaatggtactcttccagcctccagaactgtaagaaaataaattgctcttctttagaaaaaaagaaaagaaaaaaggctcaggtcatgatggagtaattgacaaagattagatttcctactataaacaagcataaaacttgtgaaaatatataaagccactgttttatgtatgtcaggttttgactaatactcatgtaagactgagatccttgagagaagggaaaaccccactgtcactgtctctacccagggcacttcccaaactgtgttatggagaggcagagcctaagctggaaacagtggtctcagtgatctgaagaagcagagaatttggggcttctgagatggctggagtttgtggggcagaataagggggagaagaaaaaaagagctccagaaatctgcaaaaggttccccttaagtctttgatcaaatactaagcttgtagataacagcttacaaggcctagtagaaaagagctgcaaaggagaggtgaactggagattttatagattactaggagataaaagttctggacaagcgagtggaaaccttactgaactccttggacactccattgacatctcagaaagaccacagtttaggggtagggccaaagccatagagtaaaagctactctagacccaaactaataagcttaaaaacaagcctcaaaaggatcaaggtgatttgccagtattttgactgcttgtggaaacaaaactcaatatattctctaaagataataaaatctctatgtccagttatgtagcaactataatgttcagcatgcaatgagaactttctagatacacaaagaattaggaaaatatagcttacaaccagggtggaaaaaaaccacaacagtcaacagaccctgcaatactagaattatcagatgaggatcttaaaggctctattttacatatgtttaaagatacaaaggaaaatataatcttcatagaggaatagatgtggacatctcaggagtaaaaggaaaaaatataaacaagaaccaaatagaaattctagaacttgcaaagtacacaatctgaaattaagaattcactgggatggggccgggcatggtggctcgcacctgtaatcccagcaccttgggaggctgaggtgggaggatcacttgaggctgggggtttgagactaggctgagcaacatagttagacctcatctctaaaaaaaaagaaaaaaaaattctgaatggccttaacagcatcttggagacagaagaaaaagggtcaggaagtttgaagatagatcatatacacgacctgaagaacacagagaaaaataatgaagaataaatgaacaggccaggcacggtagctcacgcttgtaatcccagcactttgggaggccaagccgggtagatcatctgaggtcaggagttcaagaccagcctggccaacatggggaaaccctgtctctactaaaaatacaaaaatgagctggatgtggtggcccatgcctgtaatcccaactacttgggaggctgaggcagaagaatagcttgaacccaggaggtggaggttgcagcaagctgagatcacaccattgcgctccagcctgggtaacaaacaaaactctgtctcaaaaaattaaattaaattaaattaaattaaaaaataggccaggtgtggtggctcatgcctgtaatcccagcactttgggaggtcaatgcaggcagatcacctgaggtcgggagtttgagacccacatgaccaacatggagaaactccatctctactaaaaatacaaaattagccaggctggtggcgcatgcctgtaatcccagctactcgggaggctgaggcaggagaatcgcttgaacctgggaggcggaggttgcgttgagctgagatcacgccattgcactccagcctgagcaacaagaatgaaactccgtctcaaaaaaataaaatataaatgaacagagccttggtggtctgcaggacaaaataaataggactagcatgcatggaataggaatctcatacataaggaagagagagaatggggcagaaaaaaactgaagaaaatttccacatttggtgtgaaaagaagttcaaagaccaagatagacaagggaaaaattacaccttagcaaattgtagcaaaaagttaaaaaaagatcatgccactgcactccagtctgggcaacagagtgagactctgtctcaaaaaaaaaaaaaacaagagtgaaagtgaagagccatttttagatgaaggaaaatgaattgcctgcacacctacactacaagaaatactaaaggagccaggcatggtggtatgtgcctgtagtcccacctactcaagagctgaggcaagagattgcttgagtccaagagtttgagtctagcctgggcaatgctatcatagtctactatgattgcacctgtgagtatctactgcattccagtctggttaacatagtgacacaacaacaacaacaacaacaaaagaatagcttccagccgggcgcggtggctcacgcctgtaatcctagcactttgggaggccgaggcgggcggatcatgaggtcaggagattgagaccatcctggctaacacggtgaaaccccatctctactaaaactacaaaaaattagccaggtgttgcagcaggtgcctgtagtcccagctactctggaggccaagggaggagacttgcttgaacctaagaggcggaggttgcagtaagctgagatattgcaccattgcactccagcctgggcaacaagaatgaaactccatctctaaataaataaataaatagtgtaaataaatactgtataaaatgcaaagcactcagaatagccaaaacaattttgaagtcagaaaatagcacttacatgctctgattttaacattacctataaagctgttgtaaacaagacaatgtggttttggcataaggacagagaaagagaacagagttcagaaatagacccagacttatgcttgttttcaacaaaggcatcaatggaatgaaatggagaaattaaagtcttttcaacaaatggtgctggaataacagattactcacatgggaaagatgaacctagatccctacctcacaccctatataaaagctaatttgagataaatcgtggatttaaaaataaaagcaaaaaatgtaaagcttctagaagtatatataagagaatagcttttacagggtgcagtggcaggtgcctatagtcccagctactagggaggctgtggtgggaggatcacttgaggccagcagtttgaggttgtatagtatactatggttgattttgcctgttagtagctgctgcactccagcctggtcaacatagtgagacatcatccaacaaaaaaaaaaaaaaagaaagaaaaacagcttgataagtaaagacaagacatagaaagcaaagcaataacttttttgtgtgtgtgtgtggagacgggtctcactctggcacccagattggagtgcagtggctcaatcttggctcactgcaacccccacctcagcctcctgagtagctgggaccacaggtactcaccaccatgcctggctaattttttgtattttttgtagaaatggggtttcaccatgttgcccaggctggcctcaaactcctgagctcaagggatcctcccacctcagcctcccaaagtgctgggattacaggtgtgacccaccaaacctggccaattctcacatttgtagaagagagttacaaatacggaaagggagaagaatgtagcttgtggtgttaggttgcattttggagaactcaaaatgcagtatgaactcaaggtgttaccatgagtgtgtgtgtatatgtaaaattataaataatacatatggaagtttctactgaacagacctagaaacaatgacaaaccagtaacaacaagcagtcctgacacccagatcttctaaatacatttatccactaaaaggaactaaggttgtttggagaaatggccctttccaaggctagggaaaaaatgctaaaaaattaaggacatgctcagggacatgttgaaagcacacaggaggcagcctacggggcttccactttcctgtagtggaattttgaacaatttgagcatcagagtcagtaatgatagtaatgggttgtaactgcccaaattttgaacaatttcagcgtgcaaataagttatgatagtaatgggttgtaactgcctaaattttgaacaatttcagcgtgcaaataagtaatgatagtaatgggttataactgcccaagtattgaaaaatttcagcatcaaagtaagtaatgagagtaatgagttataacttattcaataaaatgaaaatgtatgagtccatcctgatataaataactgaataaatgggagaaaaggaaaaggttttctttgtggtaaaatgccaattaatatcttaccaatagaaggaatgttggagttagaaagtcatgaatgaatgctaaaactagtgggtgaaaatatgatggggaagaagatatttggataatccaaaaagaacctctgataaattattgattacttataaatgaaaaaatggtacctttaaaagctagaaacctggtgaataccaaaccattttaaccaagtgatcaaagataacatcacctgggataaactgattgtcatttgtgtcctaataagactcactgagaaaaatcatactatcattcagtggtatacctgccttttggcagaatcttaatctaattctgaggaaacatcagacaaatcaaaattgatgacccttaacaaaagaactcgcccatgttcttcaaaaatatcaagcttaagaagcatagtctgaagaactgttacagacaaaagcaaactagagagattgatagttgtacaatgcatgcttctttattggctcaaataaaggagctagaaggacattactgaaatataggtgaaatttgaatgtggaccaaggattagataatagtgtttgattcatgttaaatttcctgatttttgttttgttttgtgagacagggtcacccaggctggagtgcagaggcacaatcatggctcactgcagccttgaactcctaggctcaagtgatccttctgcctcagcctcccaagcagctaggactactagctacatggcacacacaccatgcccggctaaatttatttttaatggagacagggtctcgctgtgcccaggctggtctcaaactcctgggctcaagtgatcctcccacctcggcctcccaaaatgctgggattacaggtgtgagccgccacacttggcccaatttcttgagttttataactgtgcttatgtaagaaagtggccttgttttggggaagtatacactgaaattaaaatttaagagtaagaaggcattgtatctccaactttctctcagatggttcagaaagaaaatattaaagcaaatggagggaaaatataaatggtgactctgggtgaaggaaatttctgtaagtttacaattatatagaaagggaaggagagaagtatgactcctgagagtcactgcaacatttccaaaccaactgccagtggcaggcagggccaccccacacagagcattgcacaggccaccatgagcctgctagcatatgtggtcagtcagtgcttggtcaaatgtggacgacttgagctatcaaatgccagttcatgaaaatgttagttttttgctgtttttctcctttcccagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtgagtatatcatagtggtttaaacatcaacctatttataggtaagagtaacatctaaaagagtaatacataggaatctttagaaattatatcttagttatgtttttcaggttgcaaatatatgtcctggatacatgaatgtggggagggggtatgctgggtttacaggacacggtaacatgggacctatgtcagcactcaagcactcttggttccagagcgtccatgaccactgtgcacacacagcaggtttcatgagaagctggagcactggctcatggttgttaggaggcaccagctgacctgtttcctgtataggctcaacctcctcagaagtggacacccattacttctcgctgtttctgtgtgatctccatttcacatttctaaagggtggatcttttggggtcactcgctattttctaatacagaatgctcccgtcaagctcccttattgataactgatatctcttatgtcctgccagcagtgcacgattggctttgagactgcctgatccactcactcgtaaccagccaagtactatgacccaaactatagcagaatttggcacaaacaggtccctggtagctactttcctcaggaaggcctatggatttggaaaacacaggtgtctcataaggacatactcataaattgttttcatgtacaataattcttgtgtgtactttcctcctgttgtcatcaaagtggtcacatattaaaacttttctgctaaatatgaatcctcatgtttaatggcagagaacccaccattcccagcacacttacttctgtctctggactaatcttgagtaattggttttcctttgcttaggtcttattgaagttaaaacagatgagtttcctcgccatgggagcaacatagaagccatgtccaagctaaagccttactttcttactgatggaacgggaacagtcaccccagccaatgcttcaggttagattttctgaaggacatctgggggaatactatgttctataatgtctaccgagtgaatatttttctctttatttatatacaaaagtactattttttgggacagggactcactctgccagccaggttcgtgtgcagcaatatgatcattgctcacttgcagcctcaaactcctgggctcaagtgagccccctgccttaacctcccaagtagctgggggactacaggcatgagccaccacacccaactcaatatttatgtacaaaattattcttaaaacagtttaaggaaacatgtcatttctctgtatttgatcattgacttaacctatactgaaagaattaatttggtttcttgacatcccaactagacatacaaatgaagaagtaaattagggaacttcagtttatctacctttgtatttttccagtaccagaaactcccaatacctccttgtgaagcccaggcttattcttccatttcctgtcagagatctcccctccccaactgctgtaatcctttttttttctttttgagacggagcctcactctgtcgcccaggctggagtgcagtggtgcaatcttggctcactgcaatctccgcctcccaggttcaagcaattctcctgtctcagcctcctgagtggctgggactacaggcgcacaccaccacaccggctgatttttctattttaagtagagatggctttcaccctattggtcaggctggtctcaaactcctgacctcaggtgattcaccctcctccacctcccaaagtgctgggattacaggcgtgagccaccacgcccagccccgactactgtaatcctaccactttctctagttggaaagttttgtggtcaatatattgccaaacataatttctatgtaaagtctgttgaattatagtaaatgccttagccaacaggtaaaatcatttaactcatgtcttcaggtggtaaagaagccacagatatgtaactgaggttaataagcatggtagaaattaagtcactcatattttacaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgtgagtataaccctattcccttttatgaaatttgtcttcctgttagccttaagtgagcttattcatgtagttagctctagtctttccctaccagaagagtaaccaagagcatttatttctatttttgagataaggtcttgctctgttgtccaggctggagtgcagtggcaccatcatagctcactgcagcctcaaaactcctaggctcaaatattcctcctgccttagcctcccattacctcgaactacaggtgcaccaagccttcttcatttcgtagagacaaggtctatgtcgcccaggctggttttgaactcctgagttcaattgatcctcttgccttaggctccccaagtgttgagatttcaggtgtgagccactacccccagccactgagagcatttggatcacatgctttctaggggaactgattctgttacattagccttaggtacacataacagatgctactggttcaaaattttaagacaatttagaatttctaagggatcttttagatcacacccttaaccttttggatggaatggatgtcactaaggcaaaaatgtgtgagaatgtcactgtattaacctaagaacaaaccaaagtagcagttaccagtatcatgcagcatatatttatgttgacaaagaatggtttaactttagcctttccacccaagtttagacctcttttctatgaatctttcctctaggttacaaaagcaggttggtcactggaagatgttgacatatttgaaatcaatgaagcctttgcagctgtctctgctgcaatagttaaagaacttggattaaacccagagaaggtaaagatgcacaagtaaccctgagagcttaccagtgaatttcacaatccaattttaagatagtatcttctaggtgttggccatgtgggtaatagttaaagaaatactagttactaggactgagttcattacttcccaaggtttaaaaaaaaaaaaaaaaaaaaaaaaagacattggcttacttggcataaaaggaacgaggtaagataggcagggatgaattttcacaaaggtgtaaatttattcctaagcagttaaaatgaaaatttgagtttgaaagggtagcatgctgatacattaagaggaaaaagacaagtttaagattttaaactgtgtccacagaagaataaacaatctaaatcttttctcccccgttaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatcctgcaattaagaaagaattatttaacggccgcttacaatttcattaggtggcctattaactccagcatttcattcaagtattaaggttgatttttaaatcagactagagatcttgtaggtagtctttctaccaaaagaagcagggagagattagcaatcacagttaacgaagacacaccagtgctaataattagtcattatcccttgaattacagtgactgaacaacaaatgcttgctgtgaagtttttcatgttaagtatttgacaagtctgttacttatgtttgctgacatgtaattgactactatcctttttaatgcaacctgttctgcagaggttaacaaagagcgggaaaccatgcttaccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagacccctaggaaaagaagaaaattaggtgacttcacaaaagggaaaaaaaaaattgaagtccacagctactgctctcaggcctctaagacaagaaatgactgttcttaccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtactgttcaaaacaaaagtacaattcttgtaatagcatttttaaaaatttttttttgccaagaccatcaatttctcaaaaaaaatggcattttaataaaataagtctacataaagttcccttaagtcctgcctacacaggatatttagatatactatacagaaacaatgtctagtccctgcagaagagatgaaaatggttacttcatctcaatttacagtggcccaatgttattttatcccatgcgtataactgctcgtatcactgtgagactacaagcagcaaataaatgggaagaaaacctacttttacttaacaaaatcggtataactttacaattttagaaagtggctcttactttttgattaagatcagctcatcatcacaaattctctcctgtaccacttcttctgcctgtcccaacattgcagcttcaaaagtttcttcaccttccaaattggccagggttgacagaatagttgctaataagagagttacaaaggatctgtgaatattgctctttcatgattttaatatccttggactcagtagcatttgtggtaaaagtgctatattacaagtttagaatttagttaggcagcacacggtaactccttttatcctaagatggaactgtcattttagaaatgaacaaattcagttcacaaatttccaacaaaatttctccagttacatgaaaaatggctctataaatgtgttggtagcacaaagcattaagagaatataaatgtttttgagctgttttctgtcaatattccaatgtaaaaagacctttgataggatcagggataataaaagtattttatgtgacagccagcacaagacatacctccagaagctttggcaatgcgtttaaggtccctttttaaaactcttctaactgccatagcaccagcctccacaaaatacttcagacacatatcatcaattccaccagtggttagaataacattggcaccagttgccaggatcttctgaattctctccttggtgatatctgattctctgcaaagtatttttgtaacctgagttaccttctgtgatttttaaaaataatttaacttccattaagtatttatcacaagataatcatagatcaaattgtattatcctttgttatctctgaccagaatttaaattagtccaattcatggaaaatttgaaggaattaaaaattaccacttagctctccccaacccaaatttgaattactaattgagaactatggttaaacagggaacacaggtcctgccttcaaggatctagtggggagagggattaccaatcacactccagggcaagtgtcactaaagtggtatgcagagattacaagcacataaaagacataaatttagcctaggaggtggacaatgaagatgagtccaggccaagtgcagtggctcacgcctgtaatcccagcactttgggaggctgaggcgggcagatcacctgaggtcaggagttcgagaccaacctggccaacacggtgaaaccgcctctactaaaaatacaaaaaattagttgggcctggtggtgggcgcctgtaatcccagatactcaggagactgaggcaggagtatcacttaaacccggaaggcggaggtcgcagtgagccgagaccgtgccactgcactccagcctgggcaacaagagcaaaactccgtctcaaaaacaaacaaacaaacaaaaacaggagtccagagttgaaagcacaaaagaaggcagaaccagaaaagtgaaaaaccttgcaggttacaccaaacaatctagatactaagcttaatatctctaagcaagactagtatatcatctgtgttttcaaaaggattccctgattatcaatgtggaaactgcactgaatggctgaagacaagaagataataacatgagatataagctgaaagacaacctaaacagaaaagtcaaattttatggcttgggtgactcctggagtaaaataaataacaagagttttgggggcaggatgggaaatgagagtttagttgaggacaagattaagtttgaagtctctgctgttactcaggtgaagctcccaggaggcagtcacttacatcatggaaaccataaactatgggagatccagatttgaagagtcaatatgagtgaagccatgtgaatagatcattcgaagaatttttaaagtaaaatgaattacagatcaacctcaaaagcagcttgtctactaaacaagtactgtgtgctacacactgttatataaactcatggtaaaaactgtaataagccccaggaagaaaaaatacaggaagttacaacagaatataatttagattgaagaagaaagaaaagcttctctaagagactagcttgggtgtgtttctacaacagtctaggcaagaaaatgaaaagtaggtaaatttaatttggaggtagaaatcaagcggtcttggtgacagattaggagaaaaagtgttggtaaaaaggaggagttaaggacatttcctagttttctgcctgtgtgaaggactccccatcactaaaatggtcaaaagcagatttgcggtattatcacaagttcagttttagacatgttcactttgagatgcttgaaaagcattctactagatagaggtatgtgtgtttggagcttagagaaacagctgaaagagtctctggcatagagagataatacatgaagtcatgggaacaaaggggctatcctggagagtattatgacatggtccagacaaagcagcatcacaaagccttccatccccgaaagcatttcaagaaggacataatcaaagggttgctaaaggtcaagtaagaggaaggctgaaaatgtcttccgaatttcacgctagagaccttaacatgcagtccctcaaatggagaacagggctgaaaagggatgagaagaaaagcaccagagaagttttgtgtagtaaaccactcatgacatctgcctgtaaagatgtacgatagggagtacctatagcacaaggatgtatgaagaagcttgaaggacaaaagagccacaggaagaatccaggaaagagcataattagttgaagatgcaagtatgaaacaagaatcaaagaaaaggctctagagcagaaggaaacagactctagaacacttactgtagagggactggctttgatggaagaaaggacactttgttgtatgaggaaggaaggaaaaaagaacacccgtgcagactgatttaaaagatgacagcacatttcttactcttggcaaagctttcttgtaggtctaactactgtttaaactattttttttttttttttttttgagacagggtctcgctgtcacccaggttggagtgcagtggtacaatcacagctcactgcagcctcaacctcctgggcttcagattcttgccacctcagcctctcaaagtgttgcgattacaggcatgagccactgtgcccagcctaaacaatttattgttttaagtgactgtcaggcagtcaaatctatagcaatggtcacactacctccaccattagctcttctggcatgccaaccactaatatcacctgcacctccagtatctagcaaacagtaggttacagtcaatactatactgctgagttctgtactgctttgaggaaattagattcctgtcttttacatctttaatattaatagactcatacaatcaaaattccacaaaaaggccgattttcatataggttgtataaccccaaatccctctaaaaacaccaccaggctaatttttctggaagtaaaatagtttgacttggctaaaaatgttaaagtcctccaagacactcacacttaaaaggccaaaaataatctctcaacatacctctgtctaatttggtccagtttttcagggtctgtaatgaccacctgtacaccaagcttcatttttgttttttgcaggctgaagtcaaggcaagcaatttttgcatttacgattctcttgggcatgcctacaattgaacataagattaagttaatacgtctatccttaaaagcataataaagagtacctataatcgattgtatgtaaacacacaaatttagactaattcattgcattttatcttagaaaaattttatggcattaaatgcacgtaatttcttttaattcacattccttctaccatgttgtatgtgctttaaattacaaaaagatgtactgcacataatccacaaaaaaacattttttatttttttttttttttgagacggagtctcactctgtagcccaggctggagtgcagtggtgtgatcttggctcactgcaatctccgcctcccaggttccagtgattctccttcctcagcctcccaagtagctgggactacaggcaggtgccaccatgcccagctaatttttgtattttttagtagagatgaggtttcaccatattggacaggctgctctcaaactcctgccctcgtgatccacctgactcagcctcccaaagtgctgggattacaggcatgagccaccgcgcccagccaaaagaaaagctagttttaatctgtagcaatctcattctataaaccaaatcccaaaccttaccctgggatcccaccacacagttgagtgcatagccactgatgagcatactctccatttgacttctcccatgggctttcaaaatattaacagagttgactggatagcgtggctggcctcttatgtctgtgtatttaatagcaagtacagcatctactaccatgttagcaaagaaatcaccatttctacgccaaaagttaaggacagtaacaggtttggaatggacaaagggtacacacgtgaaaaatcaagggtaatttcaagggacttccttttagtaatctaatctattaaagcagcaagcattacttgtcaccaaaatgttacaacattatcactatctgcaattcatatcacttttagacatgctttttattaccttttcaccctaaaaaagcagggaaggcaacaggtaatttcaatacagcattactcctctctattgatatcaatttgcataaaattggttattcaaaattttattgcacaaaattgatactgctgctactacgcacgcgtgcgcgcaacacatgcgcacacacgcacccactcccgagacagggtcttgctatgttgcccacattggactggcactcctgggttcaattaatactcctacctcagcctccttagtagctgggactacaggcacataccaccatgcccatctcaaagtcttatgctttaaaaagtctaaattttatctgacaaccacaaggatacattccaatgattttggaagacatggatgtcttagcagcattaatcaggcaatctcttcccagttcatctgtgttaacaattaggttttcattgatataacgcactgcttccctgtttaaaagtgtgggggagaaaaacgcttataaagtcactactcaaactctttgcattcatcatgcttaacacagagccaaaatgtcgtaagtaataatatccgttcagccatttcatataggaggaggacatgaaaaaaccctccctcttcagatcatggcaagtttaatctatcccataagcatagccactaaaatctattattaggagaaaatgtggtagtcaaatgagaaaaaagatactggtccaagtttttaacttcaaatattactacttaaatgctaaaacatttaaattgaaggttttcaaattaaaatttagttattaatcaaaacgttaagacaacacagtttacaactattacatcaaaaaaaatttctctgaatgcaaacaatcttacttgcaagcaagtcgatagccactaataactgatgtgggatgaattttctgtttgactaattcatctgcattttttaggagttctgctgcaataataacctgttgagaaaacattcactggtctgagtgtgccggatattcaacatgtgcaatacatatggaatgacactaaaatggccatatattattaaccaaaatggtagtgatgaaatgaattaactggttattagaaacctgggcgtgaagggagaagaacgctacaaaacactccaagtcctccacgttactcataaattcttggaaactgccactttaagcaaaacaatggacagcaatttctcaaatacagttgtttattgtaacgctgatggggggaggaaaacttgtttttttatacatcatctttcctcttaaagtcagtttccatgaagccactgtggatgttcagtgaggtcttattgtattataaatgcaaatggccaaaactgggtaggagccagaaaaatgttctaagaaactagttcagcaataagaaactagttcatcaatacaaccgtaaaagacaacacatctattacctttagaaaaaatgctcaacagaagctaaaccgagtgtgactattcatatgacctatattaagctattattttatttaaaaaagatagttcttcaagttgataaaacactaagaaatatttttaaagcaaaaagactgtcagcttcttatggaaggaaaactacatttgttaaatcacattatcgtaagttagacaaagatcatattcatattttaggagtagattccattctttcatggctaaagtttaatctagaaatacattttccccacaaactatctagtttctccagaattaacatctttctcaccaaacaatagtgtttctactataccagcatgctggatgatctatgaagagtttatactgtgtatcacatttactgactcggtaagatcacactgtcatatcatgatgtatttattaatttctcacactcccattttgaattcctgagattacctgtcaggatttaaaaaatagaacaggctgagtgcagctcatgcgtgtaatcccagcactacagaggccgagaagggaggatcacttgaggccaggagttcaagaccagcctgggcaacatagcgagaccctgtctcttaaaaaaaaaaaaaagaggtttttaattagttgcttgtggtggcacatgcctgcaatcccaagcactctgggaggctaaggcaggaggattgcttgaacccaggagttccaggctgcagtgagatatgacagcactgcagcacttcagactgtgctacagatggtctcttaaaaataataatataaaaacattgtttctcccccagattggtaacattttatcctccaaataatcagaaaagttgagagctttccaagtctcaaggggtgatgggggaggaaacaagacttttgagagaccataaaaaaatctgtgtgatgtctgaatactgccataaaaggaaaaataagccctcaaaacttgtgaataccaacatttaaaacaatggggctatgtcaaatgaactcaaattctttcctacttaaactgtacaaactagctgtaactatcaacttacaaattttgtttctgaatctgtacctaagaagcttatttcccctcttaaatgtgtaacttcttttgttttttcttcttgctcaatcttctgggcattcagaatatgtaacttatttctgacacagcacaaatgacccacttatggcttcaactttctgaaagtcggtcgtttttagaaaaatgatcattctttagccagtctacctaccactgaagtagttccatctccaacttctttgtcttgcagatcagccagctcacaaagaactttagctgcaggatgttctacctccagtaacttcaggatggttgcaccatcgttagtaatggttacatcctaagaaattcgcaggaaaaaatatgaaccacttatagaaatcaacacagccccattataatacacgttcacctttaatatcaccttccagtacgtggattctgataaagtcaaagaaagaacatagcaaaacactgaagatagttttactttaaggaaactaacacaacagttatgtgtacttacaccaatatcatccaccaacattttatccaagccaactggaccaagagaactttttacaatattggcaatcgaagctgcagccataactgtagacaatcaattaaaaataaaaaagaaatgaggataagccacaactctgaaagacagtaatttcagcctaaaggtaaatgacatccaacagcccccgtatttcccaaatctacaaatctgtgttaattatttaaaaaccacctactaagagtgtaaatggggccagacactgtggctcacaggtgtaatcccaacactgcgaggccgaggcaggaggatcgcttgatgccaggagtttgagacccctttgggcaacatagcgaaacccatttctacaaaaaataaaaacaaagccggatgcggcggcgcggacctgtgcttggagaatgcagtgagctatgatggcactctcgtctgggcgacaggtgggaccctgtccctaaacaaagcgagcctatttggcacagctttgatgcggggtggaatctgatggcggggaaaaaaaaaaaaagtaataaccaccaatttcatgctctgccacttcgtacagctataccagccttttccttcagattctgcaagttttttgctcattaaaactctctttatctgtgaggagagaaatcggtagtcaacggggaaggtggtgactttcagatttgtttacgaaaaaaattaggaatctatcaagaaacagtaagctctgtaggtatccaaaggcctgacagcaaacgctctgctaagttagcgctgccgtctcctggggtcaatgcactcgagtggcgtttcctgggctaactctactgtaagaagctgtcaacccggatacggctggacgccggacgcccgacctcgactgcagctgcgggcggacagggcaccgggctcatccgagggcgcgcggatggacctactctttttctggtaaatggtcctaaaataaaacctggcgtttaacatggacactc

SEQ ID NO: 1019 - DNA, 29511 bp, Homo sapiens
aggatgctgaaccacagggaggcctagagtggggtggcggagtcaagtggggtgagcagggcttttgcatggagaggggcggccgtggcgcctgatgtgggcaaggaagttgtgtctgcatggttgagggagtggagagagggaagagggtgattgtgccctcgggagggtaaaagagtccaagcatcctaaggaagacgtgcatttggggagtgtgtggcagcaatagtggaagactggttacatacaaggagattaatcaaatatgtaagtatattgagtaaaatgggaaccacatttttcactgtcaaagaagggaattataaacatggaaagagagaaactcgaatcaactctgtggtgttgactttgaattgaagacattgatacaaatttaaggttttcagtatacaaagtaagacagttgtgaagcaatctgattgcagattccttttacatttttattaccttaatcttttataagtatctcaccctatgcttaatttgatggctcttctttttttttttttttttcttcttcctaatagagacagggtcttgctctgccacccaggctggaatgcagtggcaggatcatagctaactacagccttgaactcctgggctcaagtcaccatcccacctcagcctctcgaatagctatgagcacaggtgtgcaccatcactcccagctaatttttaataattttttatagaggctggacccagtgggtcatgcctgtaacagcactttgggacgttgaggtggaaggattgcttgagcccaggaatttgagactggcctgagttacatagtgagaccctgtctctaaaaaaaaaaaaaaaaaaaaattggtgacacacacctatagcctatagcaccagctacttgggaggctgaggcgggaggattgcttgagcccaggaggttggggctacgctgagccaggattgcaccactgcatcaaggttttgaactcctggccttaagcgattctcctgccccagcccctcaaaatactgggattatagatgtgagctactgtgcccagccaatagctattatttttgcaactcattatcaagttcttccaaagctttcaacacggcttttatagtagtaataatggcctttgtttttgcatgtatttcatcaatttacatgcttaattaaatttggtgttaattgcaataaaagatacaattggaataaacaggtttgagaacaactacaaccaacccttggtttggtaagcatagaactcaactggagggagccgaagattgtcatactaccagcaagcatttggcagaccatgagcattagaatgaccgtgaggttagaatgttttatagagggaagggaatgtgccagttagtatgttgtgatagctaagtggttgttgcatagaagaacttgtacaggtctgtgaggctgggatagctgcagcgtaaagaagaagtggaaaaggtggagaaaggcggacaagtggagaactttacatcttggggatgtaaagttcttaaaacagtgcctgactgggcgcagtggctcacgcctgtaatcccagcactttgggaagccgaggcaggccaatcacctgaggtcaggagttcgagaccagcctgaccaacatggtgaaacctgtctttactaaaaatacaaaaattagctgggtgtgatggtgtgggcatgtaatcccagctactcaggaggctgaggcaggaggatcactggaatccaggaggtggaggctgcagtgagctgaggttgtgccaccgcacttcagcctgggcgacagagcaagccttcatctcaaaaaaaaaaaaaaaaaaaaaaaaacacacaaagaaaatccccccaaaaaaccagcgcctagtacatagtaagcacttaataaggttaagccattgatattctcatgattattttcatcatcattttcatgaatgtttggaagaataggaaggggcacagatctgactcctgccctcctaactcagccactgctctgagctgaagctcttctaaagagagcactgtgggaataacaaattagggcacatccatgtaatggaatacctcagcaataaaatgagatgagctcttgatacagcaaactcagatgaatctcagaggcatgatgagtgaaatgaaacaagacagtctcaaaaggttgcatactgcctaattcatttacatgacattctatttttaattttattttattttatttttagagacagggtcttgctctgtcacccacgctagagtgcagtgattcgatcgcaactcactgcagcctcgacctccaggcttccgtcatcttcccacctcagccttctgagtagctagaaccacatgcacctaccaccatgtctaaattttttttgtgtgtgtagagatggggtctccctatattgcttaggctggtcttgaactcctggcctcaagcaatccccccgcctcagtctccccaggtgttgggattactgtgctcggtctataggacattctatgagggcaaaacaatagtgatggagaacagatcagccaggggctgggggcgaggggagggtgtgattacaatgggataccacgatggagtttttgggctgttgcaaatgttctgcatcctgatttgggtggtggttatttaagtctatacatatgttaaaattcagagaactttatatcccaaatttgctatatgttaattaaaaaaaaaagtaaaaataaagccttaagaaatgaagggaggcggggcacggtggctcacgcctgtaatcccagcactttgggaggccaagggtggcggattacctgagggcaggagttccagaccagcctggccaacatggtgaaaccctgtctctactaaaaatatacaatttagccatgcgtggtggtgggcacctgtaatcccagctgcttgggaggctgaggcaggagaatcgcttgaacctggaaggcagaggttgcagtgagccgaggtcgtgacagagcaggactccatctcaaaaacataaaaataaaaataaaaataaaaaaaagaaagaaatgaaggggccagacaaagcggctcatgcctgtaatcttagcactttgggaagccgtggcagggggatcgcttgagcttaggagttcaagaccagcttgggcaacgtgacaaaaccccatcttaaaaaaaaaaaatagaaaaattagctgggcatggtggcacgcacttgggaggctgaggtgggaggatcgcttgagcccaggagattgaggctgcagtgagccgtgtttgtgccactgcacttcagcctaagtgacagagaaagaccctatttcaaaggaaaagaaaaagaagtgaaggccctgtagagagcgtcctagtgtctaagctgacctggccccaagcgctgctcgaggggtgcttctgtgacggcgcagcatgtgtgcccaggcctggttcctcacggccaggcccatcatcactcactggctttttccttcctcgtgttagattggagctggagggagcatcactgggctgaagtttaaccctctcaataccaaccagttttacgcctcctcaatggagggaacaactaggctgcaagactttaaaggcaacattctacgagtttttgccagctcagacaccatcaagtgagtagtttaactagcaggggaaagggcttctaagcttaggtgtagttccggcaagagcatccagatcccatttccttaacccaacctggcccagggaagaaaggaaagatgtcagccactttccgcccttctttctctttctcaaactgctccttggctgccctcactttggtccaggtgggttactgctttgggaaggtgttctggagcctcagctcttctgtaagtcatacctgtattagactggaccttgaccctcactagataagccagcatggcgtggacccagaaagccacctagagaatggagcaacagctcagaacttgagactgaatgccctgcactcactgtggtgtaatgacctgacctgttcctgggtggaagcttatatggatggaatcttttccataaagtgctctggacttcccaagagaaagtggctggagaaattacagaatgcggccgggtgcagtggctcatgcttgaaatcccagcactttgggaggccaaggtgggtggatcacctgaggtcaggagttcgagaccagcctggccaacatggtgaaacccccatctctactaacaatacaaaaaattagctgggcgtggtggtaggcccctgtaattcccagctacttgggaggctgaagcaagagaatcgcttgaacccaggaggcagaggttgcagtgagccgagatggcgccattgcactccatcctgggcaacaagagcgaaaatctatctcaaaaaaaaaaaaaaaaaattacagaatactcgtcactttgatttccagctagagccgtgactctgactgctccctgaggaattaagtgagggtgctggggtgtaactagcattggattggatcctgggctgtcccgcagggatgaggagtgcatgcgcacgcaaatcagcaggcaattggatagacaaggctccaggctactcttccgcaagaaatcttcctgcttgaagatattcataggggatggcaaaaggcagtgtagcatggatttgagagtttgagagaaaaactgtgagctgagctcttctggctgaatagcaggatccctgaagcaccctcctagtcagcctcccagtccagtggtttgagggaccagaagagctcctggttgtgttttttcccccagtgttcagaagggggcagaagtgcttttctagccagctctgaggaacagggccaggcaatccctctttggcttgtgtctcctttggcctaaagggtgaagagtgaaaggagagagcagtaaaggaggcttgctcagaacccggggtgtggggggcaggcgtgcctcagggcttgctttatggtataagctttgtctgcttcagggacttttaggagctggggatcctgggcccagccataaccagacagatttctgagccccattatcccatcccctctgtctggacggtagagcagtctgaatgttcctcactaggaatccacggcaagacagttattcattcattcaacaaatatttattgaatgcccgctgtgggttagtcaccggagcggcaacagtgagtaaataggactatctctgtccccaagaatcttacaacacagtctctccctccagcatctggttttgtagcctggatgtgtctgctagtagccgaatggtggtcacaggagacaacgtggggaacgtgatcctgctgaacatggacggcaaagaggtgcgttctccgaggtcctgcctttccctccctcacccccacctcggttctgtgtccccacctgaaccgagctcttctctgcagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcaggtgtgatatcccagacctcatctctcctgcagaccctgcctgtctgaccactgctggggttttccctcagtgtggaagccactacgtcaaacctttacccctgatagcgtctgccaagctgatgtctgggaacctttgtggctgtggctgtccccatcagctgctgagtttccagaatttttttgttgttgttcacagcccagattcacctcttcctttccgctcctgtctagagaggagtgggagggagagtacccctgcaggagaaggcctgcaaggccaggaccacagagggcttgtggttccttcagctcaggggcttttcactttgccagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggtgagtggcggtgggaaggagctcgcagaaggaggctgtgatcatgaggccggagcaggtctgcccacagtggggaagggctgatgtggtaagcctgccaccccagatcgctcctggcccgagcacagagcatctcttacccattggctctctctcttccttttatcccacttctgccatcccatatggttgagttttctgtctcgctgataagatatttttctgagttttttcagcccagctctgatctcactgtgagaattttctaagatcctgaccctctgttctgtcttctcagcttcagttacctgtgtacagttgacccacaaaccttcattttttatttttttattattttttttaaggcagggtctcgctctgtcacccaggtgggagtacagtggggcaagcatggttcattacagccttgatctcccaggctcaagcgatcctcctgcctcactttttttttttttgtagagacagggtattcttgtgttacccaggctgatcctttttttttttttttttttttttcttgaaacggtcttgctctgtcacccaggctggagtgcagtggcacaaacatagctcactgcagcctcaacctcctgggttcaagcaatccttccgccttagcctcggaagtagattggactacaggtatgcgccaccatacccagctaatttttttattttttatagagatggggttttgccatgttgcccaagctggtcttgaactcctaggttgaagccatcccccaaccttggcctcccaaagtgctaggattacaggcatgagccactgcgcctggcaactttgccttcttagtttgtcttgcaggtttcagtgcttctaataataaaaataagtcttttattttcccaccttttctcaggctcttgttaatagcttctctatcattagtccccaacactaatagctttcaagtcctttgatgcctttttgcctaagcccccatgcagactgagctctgctagttctgcattcttttccaaaactacagatcctcttcagatcttcaggttttatgcctatacttctctggtcagttcagaatagtggtggggagcgccagtttccagcagccagaccccccgggttagaatccttgggcaaattacttatattttggatctgtttcctcatctgcaaaaagggaatactagtctctaactgatagggttgttgtgaagatgagtcagtatacttaaagcacttggccccatgcccagcacctggtaagtactggtaagtattcaataaatgatgattgaatattgagtggcccccacgtacctcaatcacatccaagctcttaataaataatgtcaagaatccttccccagttggtgttcctgttaatccatcagtgttcccgataatccatctgtctgcatgtcccagtttgtatctagccaggtgtcgtaagtcattacagcttcctgtgtgtgatttgtgacttatttctaagccttcgcatgtactatttcttccttcctgctaaccatgtctttcttccttcaaaacttccttgagaagtttaggaaaatcccatccaattctgccattttaataactgccagatttgtttttagtggggtgatctggggaatgtgggtttccttctcttttttagccattagcaattttacactcagctcttagttattcgtgttgatggagacaggatgacagtggggctcctccagaactcaagtcctgttagggtttggtcaccagaggctttttctgctttgttgtaggcctcttaggtcagtatctgggtcaggctgatgttaaaacgtttaccagttggtatgatcttaggaaatgcaaatgagggagaaggcctgaaggtgccctaagggccagggaggccagctagggattaaaaatgtgcaatggcagaggcacacacaacctaaaaccattcttgtagttttctgtaagacttatctccattattaggttggcttgttactggcaaatactacttttttttttttttttttgagagtcttgctctgtcacctaggctggagtgcagtgacatgatcttcactcactgcaacctccgcctcccgggttcaagtgattcccctgcctcagcctcccaagtagctgggactacaggcatgtaccaccacgcccagctaattttttttttggtatttttagtagggacggggtttcaccatgttagccaggatggtctcgatctcctgacctcgtgatccgcctgcctcagcctcccaaagtgttgagattacaggtgtgagccactgcactcagcccaaagaatacttttgatgttcctctttgttcatatttgtttttgatgtcccccttgatcatgttctgtgtttaccctcatggccggcctctccatctcctaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcggtgaggcttgggtcctcaaataatgatgggaggaagcagggattcaacctaccttattgaccaaaagtgaccagaaatcaggtgtctctgctaataccttcaccctctcctcatgttgacactcttgtctctgcagcttaatgaattcaatcccatgggggacacgctggcctctgcaatgggtgagtaggaggagaatgtctctgacttgccaagtccgatcctacttcccaaggttcagtgcgggccagcctcagccccgccctgccacattcaccccagggcagtggcccacgaagaagatggctgggagacagtggtctctatagccaaggccctccattcctctggctttgtcttggtcatgcaatgcctggctactgtccagtttcctagtatttcttttttttttttgagacggagtctcgctctgtccccccgggctggagtgcagtggcgtgatcttggctcaatgcaagctccgcctcctgggttcacgccattctcctgcctcaacctctcgagtagctaggactacaggtgcccgctaccacgcccagctaattttttgtatttttagtagagacagggtttcaccgtgttagccaggatggtctcggtctcctgacctcgtgatccgcccacctcagcctcccaaagtgctgggattacagacttgagccaccgcgcccggccttcctagtatttctttaccaaattgtaggtttgcgggccagccccaggctctgagagattggtaacagaaagtgtaagtcagactggtctcactcttcctaggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgagcttctgcgtggatcttccagaagtgacctggtcagagagcttcttgcgtctcagaaatgaagaaaaagcacaggaaacagcactatcagtccaataggaaacagcactattcattctctgggagctgccccagccctattctgggccacagtctagaactttcttttccagctcacaacctgcatgtagctcaggtccctggagaccccagcccagctgagggagagcagtttcctgattcgtgtgacaagcaactcccttcccaccactccctactccctcccaagtacagacaaccttccgtcctgctccagttgaaggggtgacaacgattcctgaagcattctgtctgagtctaatggtggctctagccagacacagggaaatgtggctggctggctgttgggtgatccagttccttgggagccaatgtttgtacccctggtattagctgtttttcccactaaaataagcactgagaggcaagaccgtgtccctctgagctatttgccgaagacttcaggctggaggaaaaagaacagggcttgatagaagtgcaaggtggatccagcaccaactctgccattttctaatcctaggtcctgagtgaacactgactgccagtttacatctcaggtgtgtagggagcgtggaggaggcaaatcctgtttggagaaagccagtgtccaacacagcacttggtaaacatcaggcatgggaatgctgagtgacaggcaccatgggccacgctgagccccactcgctcatctggctggggtcatcagagggaggcccaacccaggatctcctgtccatgggctggggagcagcaacagtcaggagcgagggcccagcccacctcccctaggaggtggagggaagggggctgagtggttgtcaggcgtggtcctccccatctgcgacgtggcggtagccaggaggctgggcctgcatccggaagaggacggtgaggagcagcactatgaggaggaagaggatggagccacatacagccaaggccacaatcacctctgggcatgggggaggcaagagaaaggtcatgtcagcgttccatcatatgccagctactgttctgacatataggagatacacagaggtggccaagacagagtccctgctctcatggagtttacattctaggagaggggatgtaataaataagcaaatgggctggtcacagtggctcacgcctataatcccaacactttggaaggttgaggtgggcagatcacctgaggtcaggagttggagaccagcctggccatcatggtgaaaacccatctctactaaataaagttggccgtgcgcagtggctcacacctgtaatcccagcactttgggaggccgaggtgggtggatcacctgaggtcaagagtttgagaccagcctggccaacgtggtgaaatgccgtctctactaaaaatacaaaaaattagctgggcatggtggtgtgcacctgtaatcccaactactcgggaggctgaggcaggagaattgcttgaacctgggagacagaggttgcagtgagccgagatcacgccactgcactccagcctgggtgacaggatgagacaccgtctcaaaaaaaaaaaaaaaattaggagtgacaggtcagtgacgaatgtgatacagagagacaaagcaaagtaggtcagcagggaaggcatcattgagaaagtgagaagtttaacagagacctggagtcaatgaatgacatacaacaatctgagaagagtatcacagggcagaggagacgaagggcaaaaggcccagatgtggggataagcctggcacatgctagtatcatcaagagtcagtctcaccagagtagagtaagcaaggggcatgtaggagatggggcaggagaccagatggagtagggcctagaaggccatggtgaagaacttggattttattctatatgtgatgggaagccactagaaaattctgagaggacagtagtatgaactggtttacattttttaaaagttaactcagtcggccgcggtggctcatgcctgtaatcccagcaatttgggagactaaggcgggcggatcacctgaggttgggagtttgagaccagcctgaccaacatggagaaacctcatctctactgaaaatacaaaatcagctgggcatggtgatgcatgcctgtaatcccagctactcgggaggctgaggcaggagaatcacttacacccgggaggcggaggttgcagtgagccgagattgcgccactgcactccagcctgggcaacaagagcaaaactccatctcaaaaaaataaaaaaagttaactctgctgtgttgaaagactggtagggacaagaatagaaccagaaagaactaggaagcttttcattcggtcaggcaagagctgacggtagattggactgcggaggcaagagcacatattaatatttgaaaggttgagctgatctggcagtgggctggatgaggggtatgagaaacggtatgcagaatgaccccaagggttatactgtgccactaggtgactcgtggcattgactgaaacaaggaagcctggaagaagagcagctgtggaaggaaaagcatctggttttagacattgcaactttgagatgccttacttaacatgcatgtagagatctcaagttggcagctggatatgagtctctagctcagagaagaggttgtgaatctgtgagtcagggcgtaaggacagaagtgggcatggagatgggcataaagtcatgaggctgcatgagatcacttgggagtgtgcacagatggggaaagctccagggatgagtcctgggtcatccgttctttagtgaggaagggacgcctgaaagtcagaagccaagaaagtgtttcaggaaggggtgaccaattatgtaatgctgctgagaggtgagagaagctaagaattagtcactggctttggtaggaggtgactggtcaccagacaagtatggcttcagggtagtggaaggtgacacaagactgtctaatgtgagtctaagagaacaagtggtgaggaagcagagccagattctaggcagctctttcaaggattccattctgagagggaagaggctggtggctggggaagaggtggctctcagaggtcatggatgggcttttgggagggaagtgatccagtagagaagcagaggcgtcagagctccttgcagagatgaggagagaacccaagtgcgggtggagaggccaccctaagcggtggcttcccccaggaagtaacctggtggtgggagaacgagccaattctctcttggctcttattttctcggtgatacaagtgagacatcacccgagggtgagaagtggggagaaggtataaagcagtctggggtcggggagggaactcctagcaaatgcagtcaaatggctggaagtgcgacagctcttgagatgcgtggatgtgaactgcaggctggtctagggcatgactagcaaggaggccggtgacagctcacctgtgtctgcaggaccgcttgccagctggcactcctgctgccaatccttgggcacgacgggctctgtgaggcgaaggaagtcctgcagtgggcagcggtgagggcagccaggcaggctgagcggccagggggccttgtcactctcgttccgaaagtacatctccactgagaaattcctgagggtcgacaggaggcaacatgggagctgctcagcctgcccatcatggggtccttgggctgccccgagccacctcccgagggcccccctccagaggacactgctagctccactcacccagaatcttcctggtacagttcaaatatgtggcaggaggcgtagggggcttgttcaccattgtagacatccagtgccatttgcagggcaaccagggtagtgtcgtgctgcgggggagaggggctgcccgtcagcattgttccccacacccgcaggaaccgaacagagaagaaatccagctccttgcctgacacagcacgctagggagcgcaggcactcaccgcagagtaaaccagcagcttggggagctgggaggtggtcgccattagggtcaggttcttccttatctgagccagcaggactcctgaaggagaaaagtccccggtgttgctggctacagccacctctgccttctaattagacctatctgtgctcctttcaccctctgccaggcctgggcctcatcacctacacggagaactctttagtgtcatagggaccatgtaagaactctgtggcacccctcctctctaagaactgtcaaatgtacagaaggaagcaagacaaaacaagatatctgcctatatttcaacacggatgtagaaacctgcctgtgtttacagaagcacttcagtttgaaacaaatgtaaacttaagattgcttcagagtacacagcgggtgggtgcatgcccgggtaactaccatatgctctgaaaagtgagatgtcaaaaaggtgtgacagcaggcatgcccttaggtgctcaaataaggaagctggcatgtgtgttactctcagccttctcaaaatggcccccagtggttctcttggggcagctattcatttaggagagggagggtcttctgatgtgggcgaaacttaagaacatgaatggcagggctgggcgtggtggctcatgtgtgtaatcccagcactttggaaggctgaggcgggcagatcaccagaggtcaggagtttgagaccagcctggccaacatagtgaaaccccatctctactaaaaatataaaaattagttgggcgtggtggcaggcacttgtagtcccagctacttaggaggctgaggcgggagaatcgcttgaacctgggaggtggaggctgcaatgagccgagatcgtgccactctactatagcctgggtgacagagcaagactctgtctcaaaataaataggctgggtatggcggctcatgcctgtaatcccagcactttgggaggccaaggtgggtggatcacctgaggtcaggagttcaagaccagcttggccaacatggtgaaaccctgtttctactaaaaatacaaaaattagctgggcatggtggctgaggtcaggagtttgagtccagcctggcgaacatggtgaaaccccgttcctactaaaaatacaaaagttagccaggcatgatggcatgtgcctgcaatcccagctactcagaagactgaggcaggagaattgcttgaactcaggaggcagaggttgtagtgagccaagatcgagccattgcactccagcctgggtgacaagagggaaactccatccccccgaaaaaaaataacaatttttttaaaaagaatatgaatggcagaaaaggaagagaggtggggaaatttggtgactagcggcatgaggagggggatttggttttgaaagagcagggagtgtttcagtagagagggaagtgtgtgagaagcccccacagcagatttttaacgccttagggtcctgaggagtagagtgacacgctgtccttgtcactcacccccctgaagccgggccttctccgcctgctggtagattccgaagaggaagcggaagctgaagtcctttagccggctgagacgctgcatggtttggggtgaggcccagggcggcaggcgcagcccgtgcgtttgctgtgtatcgcagcaggcaggttagcgccccaggcctaggccagcctctccagggggcagctctcttccctagtgggaaggtgcctgtgtgtgtgagggagggagaggggagagaggcagaggggctggaaccagtagacatggcaggcggtgtggatgcttcagggcacaggaaaggaagctcaggcacaaaaagtgagactcagcagaaaggagctctgggtggagagcagcagggactgctgacaattaataaaccatttcccactctgaggatctctgtcacccatgagggaagttcccgtgtttcacaagcacagcctccctggacctccccaggggcgtgacggtatcaggcactgtgttctaccgtcctggtgacctgggcctgctgagagggaaaagaatgatcacagtgggcaccctagtgggctcacctcacagaagagtgtgtcatagacattccagacggtctccagtgtcaggtctgtaagccctgtctcgttggccaccatgtccagaaattgctatgaaaaatggatcagggtctcagtcctgctctggggaaaagacagcgtggtgagctgcacctctgcccccactcactgcattccgagaactctcattctgatactctggtgtctgccgggtctcgttctgcagctgctcataacggggacatgggcccaacgggaacttcagcagctgtagagcgaagcggggaaacaggcagcgggaaaaggagcctggcatcagcaggcctacggccagagctgtcccctcaccaccccagggaagggctggccactcttaccctgtcctcagtgatgggcacagtgtgcacaggaataggctgccacgagatgttcgggttgaagcgctgcatcccgttgggagggaagagtccagccaggttggcctcagcactcatgagagtccggtcaaagtctgtgcttcgcacataaacctgcagcgatagcaacacaagtcgtgtgtgtgtgtgtgtgtgtgtgtgtgttggggaagttttggtcaccctgaagtggagccttgtatgtatgtgtgtgtgtgtggtgggaagttttggtcaccccaaagtggagccccagaggagaacctgttcctgatggtcacccagcaaactaaacctaccatacatctggccctcaccctcctctggcctctggccttccccatcccccaaacactccactgggggttgtcaccactctgtgaagaactcttgtgggaatggccttagttgaaatgccccttccagtcaaaagtgctgagtcaatcagtaaggctctctggtctgtctggtttcataacaacacctctctccctgtctagatcagggtccttggggcagaaactggctccagtgacgacccttagagaccagggagaaaaaaataagataaagggctgggcctggtggctcacacctataatcctagcactttgggaggccaatgcaggaggatcgcttgaggccaggagctcgagaccagcctgggcaacatagtgagaccctgtctctacaaaaaaaaattttttaattacccaagtgtggcgggcacttgtagtcccagctacttgggatgctgaggcaggaggatcacttgagcccaggagtttgaggctgcagtgagctatgactgaggcatgtgctacagtttgggtgacagagtgagacccctttaaaatatatgtatatattttgggccgggcacggtggctcatgcctgtaatcccagcactttaggaggccgaggcaggcggatcagctgaggtcaggagttcaagaccagcctggccaacatgatgaaatcctgtctctactaaaaatacaaaaattagccaggcatggtggcacacacctgtaatcccagctacttgggaggctgagacaggagaatcgcttgaacctaggaggtggaggttgcagtgagccaagaccatgtcactgcactccagcctgagcaacacagcaagactctgtctcaaaaaaaaaaattttttttgaagagcttattcagagatagtggctcatgaaaagggaggaggaaactggggaaggacaagctcaggacagagctgggccttaagagaacaataacaatgtctatggattcttgatacggctgaggctgacagtggtaatcagaggaacagcttcccccattcctggggtggggcgaagactcaaggagcaggcacactcaccagtcctccctgatgtgccctaggaatatagcacgacctggcgcagcagacagggctcaaaaacctcatcttgatcaagaaaagacaagccctctctacgcatgtcttccccgctgtctttcatcttggccctgtctggtttatcattagatacccccacaacattctaagctccatgaagacagagatcatatctgtatggtgcacaactgaatgcaaagtgctagcacagtccttggcctttaataggtactcaatgtcttggatggaaagcctgtgatttcacagtcagaaaccactttgccaggcccgcccttaagtccgaatttggatgcttaatcaaatttgcctcatcccagccaagcaggggcaactcagctcctagggctttgttccagacagctctcagatgtcttttcctgtagttgtgaccaaaaatacaagaaggaggccaaagtgcccagcctcagccttaggctccctgagggcaaaagatgagggcagcataccttgttccccttgcctctggagctcccaaccttacctcttgccggtgataagaggtgtttaggaagccgtgatagcgctgccgcagggcctggcccagttcccagtgctgtagcatcccctcctgtgggcaaacccaagggttaagagggtctagagggaaggggtggcttcaagccccatggggtttaggccctgttgctttccaggttcacgctttgctggagtcaattaatctgatcccagaagtctttcattaagtggccagtcatgcacagcaatatcatgggcacagagattaaggttatgaaatctggtcaaagtcagcacccatatgggaaaaggcagtttagtaggaccccaagttttgtagactgctctagacgtcgctcattctgcagctcatcctgaggaaaggctggcttctgacccaccttggttaactgaccaaacccctggggccattcttcttcctgataggggtccttgggatatgtcttcactggtgaacggtctccatggcggtacagctgagagaataaaatggtttgcctataggtcagaagcatccccttgatagggacccagagcctaccttttgccccatgttagggaaggaagtctcattccctctgggaagcctactggctgcaaaagaccccagctaggagtcagtcacttcttccagattccagagattctaacttagctaagcaatgctactggagaccataggcaaagccaaggtacaggtaggaagggaaaagagaagtgaaagcaacgtatgtggtggggacaactggggaaaaaagataaccaaaggcttctttagggatgagtcttaaccattcaaccacttccctgtctcaaggcagactcaccccgacgtattcggtcatcctgactcccataagccagggctccaggtcaatcctgaatccagcctcccaactacccaggccagtcgtcccctcctaaaccagctgttccttcccgagatcctcgacctccaccagctggcctttgcccttttagcttcagggaagtctttggtgagcccatctctcattaccaaggtaacgaagcgcagactccgggcccgggtgggcggcatcaccaccaggttcacgccgagaaggagctggaggagagccgcccggctccagccggaccgcttgcccgccatcaccgttgtaatctatgcagcaaacaagctggaacccgctgggtggcacctgcaagcagccgcccggacgcacccgtaaggacacacgccggaagtgcgttcgccgccatcttacttagggacctgctggggtgcggggaaaaggcgcagtctcggtgggattgcgtgcaggagggtcgtggtctggctgtggcggaggagcataagaaggtaacgcgacctggcgcggcagacagggctcgaagacctcatcttgattaagaaggccacaaattcgcgtttgcctctgctcggagaaatcccttaccaaggtggcacttgcagtgggcgggaccatgtctggagaaccagcgtcccctccaggcttgaccccatagctagatcgggtgcagaattgaggcgagggatgggaaagtagaggtcgcttctctccacgcccctgcctttgtggggagattgagccctggccctgttctccaggagatgttttgcttggggtgcaggacacagtatgtaaacaaccctttggactccgtgtgtccttgaggttgccccagtctggcctaccgttcctgccctgcacaaagcttcagtagccctctcactttcccttccagtcctttccctgtcctccctcccctccacttccaagttttagttaattagagtcaagacgtcatgtcatgcctcttcccaaaggagttgggttgcacaggatgttcagactttacaaacccaaagcactgaatccctgggggaggaatttcagaccagtggggaggtattttgaggtaagggacaggcgcatatcataaagtgggagtaggtggggtttccacagaatcaatggccctcttggcattgaccattaggattcaggtgcagccagtttggcctcaggactttgtgactcctgtgacggttgcaggtcagatcataggtcctggggatgctttgattcagatctgcctactggaagcaaatctcctcagatctttgggaaacaaaactgatcaggcttggcctgggcgccgtggctcacctgtaataccagcactttgagaggccgaagcaggcagatcacctgaggtcaggagttcgagaccagcctggccaacgtggcgaaaccccgtctctactaaaaatacaaaaaaaaaaaaattagccgggtgcagtggcgtgctcctgtaatcccagctactctggaggctgaggcaggagaatcgcttgaactcggaaagcggaggttgcagtgagctgagatcacgccactgcactccagcctgcgcgacagagtgagactgtctcaaaacaacaacaacaaaaacctgattaggcttggtgtggtggctcacgtttctaatcccagcactttgggaggccagggtgggaagattgcttgagcccaggagttggagaccagcctgagcagcttaggaagatctcctctctacaaaaaaaagtttaaaaattagctgggtgtggtggcacacacctgtggtcctagctcctcgggaggctgaggtgggaggatcaccttcagcccaggaggttgaggctgcagtgagccatgatggtgcaactgcactccagtctagatgacagagcaagactgtgtctcaaaaagaagaaaagaaaaaaaaagatcaggattatctgtctttattttgtcctaggactccagattcaattatttatatatacttcaggatttaaactttgcttccagagttgtcatggaggaggccaagaagcaaatagagtaagagccaaagcctgggtagccaaacagttcttaaccttcttatttaatcacaagcccctttatgaatcacatgaaaattttgcacctctcctccagaaaaatgttcacacatataaacacacacatggaattttgcatataatcccaaatggttcacaaagaccatttattacaggtttcataaatcagcatctctgaatacctgatttaacctagtcctcttactttacagcttaggaaacaaacctaaagagaggaagtgacttgcccaaattcacagtttgggcatgggcacagtttgagaatggattaaaagtcaagttttggccgggtgcgtgctcacgcctgtaatcccggcactttgggaggccgaggcgggtggatcacgaggtcaggagatcaagaccatcctggctaacatggtgaaaccccatctctactaaaaatacaaaaagttagccgggtgtggtggcaggtgccggtagtcccagctactcaggaggctgaggcaggagaatgtcgtgaacccagcaggcggagcttgcagtgagcggagatcgtgccactgcaccccagcctgggcgacagagcaagactccgtctcaaaaaaaaaaagtcaggttttgtgattttcagttaaatagtctataatgggctgcttcttgcaggctactcaaactgcattactaaactgtaattggtgatcccgaaatcctttcaataaagaggtatctgtcaaaggaaaccttttcaaattagttggactaaacgggacctaggccggacatggctcacacctgtaatcccagcactttgggaggacgaggcgggtggatcacctgaggtcagcagttcaagaccagcctggccaccatggtgaaaccccatctctactaaaaatacaaaaattagccagtcgtggtggcgtgtgcctgtaatcccagctaccggggaggctgagacaggagaatcacttgaacccaggatacagaggctgccgtgagccgagattgtgccacttcactccagcctgggcaacagagcgagactctgtctcaaaaaaaaaaataaaataaagagggcttgggtaattggcaaaatgctgcatattagtggtagtgggaggcagttgagtgttttgttttaatgggcctcttactccttgcaaactagccagaccattgtactttcagagtgtaaatctttggctcaccaaatttcagctatctctcaaattcagcttttgcttttcttcccacttgctcaaatatgtctatattctttgtgcatgcaagtatcccacgtaggagggattgatgaagcagatactatttcagtttttatagggagaaactattccaggaagggtggggattacagcgcaagtagatagtagagcctgaagctgagccctagtttcttcacccctttgccttcagcttttgcattttctgccagatgattctgtggttcttacactttggttcgtaactacaggtgcaaaaaaaaaaaagaaaaaaaaaaaacacatgtagatagatggatatgtgggcctatcccagatcaaataaatcagaatctctgaaggtgaggacaggaaccactaccatattctgtgttggcagaagcaaacctaaatccaggtatgttagccattttttttccatctgaagaggcagtttttgttttgttttgttgttgttgttgttgttgttgttgtttttgagatggagttttgctcttgttgcccaggctggagtgcaatggcgttatctcggctcacagcaacctccgcctcccgggttcaagcgattctcctgcctcagcctcccgagtagctgggattacaggcatgtgccaccacgcctggctaattttgtatttttagtagagacagcttctccatgttggtcaggctggtctcgaactcccgacctcaggtgatctgcccattttggcctcccaaagtgctgggattacaggtgtgagccaccgcacccacccggctgttttttttgtttgttttgttttgtttttgtgacagagtctcccactgtcgcccaggctggagtgcagtggcacagtctcggctcactgcaagcttcacctcccaggttcacgccattctcctgcctcagcctctcgagtagctgggactacaggcacctgccaccacacctggctaatttttttggctttttttttttgtatttttagtagagacagggtttcgccgtgttagcctgacctagtgatccacccactcggcctcccaaagtgctgggattacaggcatgagctactgcgcccggccccagccggcagttttatataatggagtgtatttgtgatttttgtttgtttgagcttgagctcaaacttttgaatcagctaaacttgtattctttttttttttttttttttgagacagtctccctctgtcacccaggctggagtgcagtggtgcaatcatggctcactgcagcctcgacctcctgggctccaacagtcctcctacctcagccccccaagtggctgggactacaggcagatgccaccacgcctggctaatttttgtgcgtgtgtgtgttttctgtaaaggtgaggtttcgccatgttgcctaggctagtctcaaactcctggactcaagcgatctgcccttcttggcctcccaaagtgctaggattacaagtgtgagccaccacacccagtcttatacctgtattcaaatttgatatttgccccttgctagtaactatctcctagagtttactgtgagaataaatgaaataatgcatgtaaagataaatgtatgtagtagggatgaaataaatgtcacatctttcctttctgccttctgtatcatctctgaactcaggtctgggaatccaggtttctggattattctctatgttgtgattggaaggttgggcagaagtcacttgagtagatacgcagtggtctgcaagatgatccctgcactttccacccttccagaacggtgaaggagggaacaagaagcagttctcctggtccatccctgcagaccttaccctgtggcctgcttcatgggaatgagtactttcagggcagttagccagtactacctgtgaccatggctggtgaatgctcctgtttctgcttcaagtttctccttgctgtgagaagaaacctgtggaggttctggggggccagatatgtgacttggtagatccccgagtgtgttcccagagacattgcctcctgcaggagccaaggaaacacagaagaggcccataggactgggggactttggacctaacaactgtgggctggtgggactgtggcacgggggtggggctgccaaagtgggaacatgattccagctgctgatcacttcactgcttgccctggcttgaagtaagtctcagtggttggtctccagaaactccatggaaatactgcccacaggttttggtcttctcccattttcctctccttttccctctttgtagggatgagggttggggtttctgagctgtaacctgataggacggctctggcagttgaagtcctggttataattcctcctaaacaggagaccctagcctgcccacccccactcccacaagatggggctcgtatgtggtcctgggtcctgggaagccacctgtggggagactaggtgtcaggggagggagttgaagaacaaagtggatgaaagaggcttctcccagctcccagaagatagggcaccaggccccagaccattgagtcctgagtttcttgaaaccagccatctctgtgacatctctggctgccctgctgggctggagcttctgggagcagggaggtagaggagggagctggactggtgatgtgggtgctgggacagaatagtgccagtctctcagtgactagagtccctggtttctgcttttccaggacagctggggccttgtgaaaatcagagagggaacacaggcgagaggaatggagagccttgtgcttgtgactcagagatacccagaccagggtgggggccttgggaggggacgaccttgtgatgagggggaacaaaagcaaaagctggaggcagaagtctgagatgggggtgtcacaggggcttttctgaaatgtgaaaatgaatacatgggcagattttgcaacagcacccagcctgctgtcttctcacactctgctccccagccccggcctgttccccctctcccaccctgtgcttcctctcatctttcaccaggctgctcttctgcctcagccttcatctttttctcatctggttccttctgtcccatctacaccccctgtccactctttccctgtttcctgtgttctcttccctggtgccctgttcatctgtttcggtctctttggctgcttgccctggcccccgtccttctatgctttaatgtggggcccatgggaactggagttcatagcaaaacaggaagagccggtgagcaggaaactgggaatggggcagggggtgaatgaccagcagtaacctcagcagcttgcctcccacatctggactggagcatctgcagggttctcagcctctcccctgtagcccaccagccctggctgcttccattacagcacttcactggcccaagacgcaacaagacaagattgtcctggactctgacacagcaaagggactggagtgaggacatctgggttctgatcccagcccagccactaactgtgtggtcttggaaaaggccctcacatgagtttcagtgttctctgtcaaatggagctcgggttacttaccctcctttcctcccagcgctgctctaaggaccagaaaagatagtgaagggtttgtgctgtgtatggaaacaagtacaaagttcaaaatccaccaagttaaagcaatgggaagacctacagctgaaagaactgggagggtgatgataactcgtgccatttctcaaacactatgtgccacacgttgtgatagactctctttctttctttctttttctttctttctttctttctttctttctttctttctttctttctttctttctttctctctctctctctctctctctttctttctttctttctttctttctttctttctctttctctctctctctctctttctttcttctttttttttggagttttgctgttgttgcccgggctggagggcaatggcgcgatctcgggtcattgcaacttctgcctgccaggttcaagtgattctcctgcctcagcctcctgagtagctgggattacaggaatgcatcatcacacccggctaattttttgtatttttagtagtgatggggtttcaccatgttggccaggctggtctggaactcctgacctcaagtgatccatctgccttggcctcccaaactgctgggattacaggcatgagccaccgcaccctgcatgatctgtagtttcaatcccacaacaaccttgtgtggtaaaaattactattatccctattttatttatctttctttctttttcttttttttattttgagatggagtctcagtctgtcacccaggctggagtgtggtggcacaatctcggctcactgcaacctcccagattcaagtgattctcctccctcagcctcccgagtagctgggattacagacccgcatcactatgcctggctaacttttgtatttttagtagagacggggtttcaccatgttggccaggctggtctcgaactcctgacctcaagtgatccacccgcctaggcctcccaaagtgctgggattacaggcgtgagccaccgtgcccgttctatttatttttcaacacaccattgctggctcaactattcttattttaaagatagggaaacaaagattcagagacgttaagtaacttgctcaatcaagatcacataggtaataagaggtttaggatttgaacccaaaatctgagcccagagtctgaacgctaaatcaacatgctgagttgaaattgactacagcagttgtgatggcgtgtgcctgtaatcctagcactttggaaggctgaggtgggaggatggcttgagcccaggagtgtgaagccagcctgggcaacatagtgagaccctaccccaaaaaaggtaaaaaaaaaaaaaaaaaggaataataaaaaaaattgactagggctaataagtacgggatagacgagaataatatttcttttttttttttttttggggacagagtctcgctctgtcactcaggcaggagtgcagtggcgcaatctcggctcactgcaagctctgcctcccgggttcacgccattcttctgtctcagcctcccgagtagctggaactacaggcgcctgccaccatgcccggctaattttttgtatttttaggagagacggggtttcaccgtgttagccaggatggtctcgatctcctgacctcgtgatccgcctgcctcggcctcccaaagtgctgggattacaggcgtgagccaccgcgcccggccgagaatatattatatttttcttgttattcattcaacaaataggaacacagtacctactctgttgccacatctatgccagccctgtttcaggggtgttgggggagatgaaatcaataaaatatgatgtctactttcagggatggatttcatgccccaggcagcagagtaggaagaatgactatagtctcagtagctgctggttggagcctgccatcacttcagatggggttgttccccagaagaggcaacccgcataccttcccaggtccatcctgggctgccacctgagttgcctgtcttccttctgccacctccacccctatcccaggcctgccactgctcatagcagatttcctatcaaaggctctcctggcctcctctcttatctgtggcccccgcagggcacccactttcagaaactccctggaaggcccagcacctgcctctctccacccctggatttctaccagcttggctgaggcctggggctagtggggagagcttcttggcctcttcccagaggcaagggaggaggagggaggctgggaaagccgctggggctcagtgtcgcaattccgggccgtgctgggacctttgctccacgaggtgcctatggaggggagggaacacgattctggaggctgctgggattggggtgggggttcctgggaggcagtccttttgcaagagctgctaagagcgctgggtaaggagaggaaggggagagacatggaacttggctggtctgcagggaaatgccactgttttggccgggagtagggggcgggagtggcgggagagggggtggccggctggggaggagccagcctggtggagaagctgccctgtgggcgggggtgaggaggggagggctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgtgtgtgtatctggggtggggtcggggaatgtcctaaggatctgagaagggggtttctggggagaagtgaggggtgatggtgatggaagcttgggacaggagcaggactctgggtcccagaataactcatgaggggctcaggggaggaggtcctctatgtgaattggggagattcttggagacaggtttgtgctgggaccctggaaagtggcacgagcgaggttctctaataagcagcgtgtttcactgggtggagtgagctgtcctcagtgttggagtgagggggaaggggcccaagagaagcagggcagatgcacccaaacattccctgctggcctggaggggactttgggggagaaaagccggcacggtggctgggagcccagactttggagtcagaggagggttggagtcttgactctaccgccgcctaactgtgtgaccatagttacttaatctctttgaacctcagtttgcttatctgtaaaatgagtttaagaatagtcctgagccaggagcagtagcgtgcgcccataatctcagatactcaggaagctgaaacctgattgcttcagcccagtagtttgaggcgatagtgtcctattattgcacctgtgaatagcactgagttccagcctgggcaacatag

SEQ ID NO: 1020 - DNA, 53168 bp, Homo sapiens
agtaagggagagggaatggtgtcaagtccacagtggaaaaggtgacccacgctaggaccttggacaatttttccatggtcattggaaggaatgcagaaagtatgggcagagttgtaagagtactggttggttaactggttagggggaataaggacattctcttctggcttttctcacttataaatctcagtgaaataagaggggagaaggagaggtactagtttagagaaacaggggaaggagtgaaacagttatctccaagtgtagaaatgtagtggggttgtcagagagtgagaacggcccacatgaatattttgcagtcaggaagttaaagtgtgctaacataattaaataggaggccattagactgaggtggctctaacactcagggttcccacataagcaaactgaagcctaactcagaatttaaaataaaatgaaatataagctcagccagtcacaggcagccaactgggctttagtatattgtcttgaacttcccaccagaacagtgcaaataaggcaattgttcaaacctttaccaatcaagtaatttctttgctcagcttccacattcaccctataaacaccctccctttgtgccctgcaatagagccctgaattacttcccatttggagctgcctgattcatggatcagtttgctcacatgtatgctttaaaattttaatgtgccttagtctatcttgtaacaagtgtaaccattgagtttaggaccaccaacaaataccatgtgcaattctccagagccatattaagcttctcaagtgtcacaaataagtagaattatctggagttttgcatagagctgggttttcccacatgagtatggtggagggagagcagtacaaagaatctgaatggcacagagaatccaagctgggcagaagataagtgaaggcatgaaggaggtgtgcttaagtcaatggacttaagattttagaggggcagaggaattattgtgacgaaggctggggatggtgtgagagaaggccaagcagggaacaggccagtgtccatagagaccatgtcgggagctggaactctagtccccacccaacaataagaagaagctccttgcaactcaggtgtcatccaaagctgggtaaagaacctagatgtctatattcacctggcaataatgaggtggtgccccttccctgtcccctacctgggcagtgtcaaagccagctaaaatataaagtttaaataaggtgcagagtcttattacaagaatgtctgtgtttgaattgaaaatcactcctcataccaaaaccaggaagagttcaaatgaatgaagaaagatgatggatagatgctaacactgagatgacagaaatgttagaatcatctgacaaagattttaaagtagccttgataaaaatgcttcagtgaacaattaggtatgcttgaaataaatgaaaaaaatatatatcagcaaaaaatagaagatatcaagaacaactaaatgaaaataaatattagaactaaaaaattcaatgagaaatcaaaagcttggtggatggtatgatactataaaatatatatttcatcttcattccagtttcctggtacatagccgctaaaacccctggaatttctgaagtggtaagtgctttttattattattattattattattatactttaagttttagggtacatgtgcacaatgtgcaggttagttacatatgtatacatgtgccatgctggtgtgttgcacccattaactcatcatttagcattaggtatatctcctaatgctatccctcccccccccccaccccacagcagtccccagagtgtgatgttccccttcctgtgtccatgtgttctcattgttcaattcccacctatgagtgagaacatgcggtgtttggttttttgtccttgcgatagtttactgagaatgatgacttccaatttcatccgtgtccctacaaaggacatgaactcatcattttttatggctgcatagtattccatggtatatatgtaccacattttcttaatccagtctgtcattgttggacatttggattggttccaagtctttgctattgtgaatagtgccgcagtaaacatacgtgtgcatgtgtctttatagcagcatgatttatggtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttatttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatctgtttgagttcattgtagattctggatattagccctttgtcagatgagtaggttgcgaaaattttctcccattttgtaagttgccttttcactctgatggtagtttcttttgctgtgcagaagctctttagtttaattagatcccatttgtcaatgttggcttttgttgccattgcttttggtgttttagacatgaaatccttgcccatgcctatgtcctgaatggtaatgcctaggttttcttctagggtttttatgggtttaggtctaacgtttaagtctttaatccaacttgaattaatttttgtataatgtgtaaggaagggatccagtttcagctttctacatatggctagccagttttcccagcaccatttattaaatagggaatcctttccccattgcttgtttttctcaggtttgtcaaagatcagatagttgtacatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgcagaaagtcactggtagcttgatggggatggcattgaatctatacattaccttgggcagtatggccattttcacaatattgattcttcctacccatgagcatggaatgttcttccatttgtttgtatcctcttttatttccttgagcagtggtttgtagttctccttgaagaggtccttcacgtcccttgtaagttggattcctaagtattttattctctttgaagcaattgtgaatgggagttcactcatgatttggctctctgtttgtctattattggtgtataagaatgcttgtgatttttgcacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatactggctgtgggtttgtcatagatagctcttattattttgagatacgtcccatcaatacctaatttattgagagtttttagcatgaaggttgttgaattttgtcaaaggccttttctgcatctattgagataatcatgtggtttttgtctttggttctgtttatatgctggattatatttattgatttgcatatactgaaccatccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgttggcctcataaaatgagttagggaggattccctctttttctattgttggaatagtttcagaaggaatggtaccagttcctccttgtacctctggtagaattcggctgtgaatccatctggtcctggattctttttggttggtaagctattgattattgccacaatttcagatcctgttattggtctattcagagattcaacttcttcctggtttagccttcggagagtgtatgtgtcgaggaatttctccatttcttctagattttctagtttatttgcgtagaggtgtttgtagtattctctgatggtagtttgtatttctgtgggatcggtggtgatatcccctttatcattttttattgtgtctatttgattcttctctctttttttattagtcttgctagcggtctatcaattttgttgatcctttcaaaaaaccagctcctggattcattaattttttgaagggtcttttgtgtctctatttccttcagttctgctcgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtttttgttctcgttggtttcaaagaacatctttatttctgccttcatttcattatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaagagagcttttttgtatgctagtgagatgactaggggttaggggttcaggatgagggctggttgccaggagaaccaaccttgtgattagagggttagaactttctctcccaccccaccaccacgccacttcccatccccctacctcttgggaggaaagaagggctgaaggttgagttaattaccaatgaccaatgatttaatcagtcaggcctgtgtaatgaagcctctaagaaacccaaaaggggctgggtgtggtggctcacgcctgtaatcccagcactttgggaggctgaggtgggcggatcatgaggtcaggagatcgagaccatcttggctaacacacggtgaaaccccgtctctactaaaaatacaaaaaaattagccaagtgtggtggtgggcacctgtagtcccagctactcaggaggctgaggcaggagaatggtgtaaacctgggaggtggagcttgcagtgagccgagatcacgccactgcactccagcctgggtgacacagcaagactccatctcaaaaaaaaaaaaaaaaaaagggctgggttcagggagcttctgggtagatgagcatgaggaagttctaggagggtagaacatctggtgaggacatggaagctctgtaccccttctcccacacctcgccctatgcatctctttaatctggctgttcatctgtatcctttgtaatatcctttataataaatgggttgatgtaagtgttgccctttgttctatgaatagttctagcaaattaattgaactcaaggagaggggttagaagtacagattacaaccttgaatcttatgacacttgaagtggggggcagtcttgtgggacttgtaaatcaaaaataaaattctaagcccccaaactgactgaattgaccctccttttgaccaagaggacccaaggaaatctgaaaaattaggccatgatggaaagccagtaggggcagctacagggggtggcggggacagacatgcctcattatactcttcccttttggagttcaagcacaactgaccaacattaacattgaaacagtgatcttaaaactgacaaaacagactctttgtagcaataagatccaaattctaaaatgactctagtacagcatcatataacagatagcaggccctgaagaaaatcaaagtcttttaccccaaaatatatttctttgacacattttgaaatggccctgcaaagctgtctcttgtggggaaaagctgcattctgtaggaaaatctccttcctttgttgcgggacaatcaaagactggagagactgaaaaaggttcaggagagtttattaaggtgatcacaggctcagccagacatacatccagaaagtctgagccccaaactaaaggctttcctacttttaaacatcttaaggcaggaaccatgtgaggcaggaagtaagttacggaagagagaaacaaaggcagttaatcaagcattacaacatttcttacatcttgagaaaaacatgtcttccaacctaaacttatcggtcttgtgaccctgaagccatgctagggaggtaagcaggaactcactgagcctgtaataaactttgatgaatgtggagttggggaatatagataaggtccactgaccacagagagaagacaggctgttaatattctcttttaacttaagtataactcaagttaaagttgcagcaactttaagaggatttaaaaatttctgttaccactactattaggttatagttgatttcattaattccttcttcatctttactatgtatttccagagagtgtgataccttttaacgtctaataagagacattcacaagtgttctctttgaggcctgctacctggaggcttcatctacttgaaaagaaccttggcttccgcaaccccccaccctttaccttaactcaagctgatttcaattcttcagccagagtttagccctttcaaccaattgccaatcaggagatctttaaatccacctattacctgaaagcccagcctcttcctcctttgagatgtcccaactttccaggctgaaccaatgtatacacatttttttttttttgagacggagtctcactctgtcgcccaggctggagtgcccaggctggagtgcagtggcatgatctcagctcactgcaacctccacctcccaggtttgagcaatttttctgcctcagcctcctcagcatgtattgatttatgtctttgcctataacttctttgtccctaaaatgtatcaaatcaaactgtaacccaatcaccttgggcacatgttctcaggacctcctaaagctgtgtcatgggtcatgatccttaaccatggcaaaataaacctctaaattaattgagacctgtctcagatactttttagtttacagattgagaccttaacctgtaggatctgacactatttccaggtagacagtgttgaactaagtaggacatgacacccaagctggtgtccactggagaattgcttggtatagtgaaaaccccccacacgtctagtgtcagaagtgttattgttagagtaggtagtcaggcagatatgggcaaggcaggaaaggcaggaatgtcaggcgacaatcaggtgatggtcaggcggttattaaactgtcactctaaaataattggttgcagtaggtgccagggaaaggcagtctcctaagagatagaaaacacctaaagctggtgatcagcagctttccaataagatctcaggaactgggcaagtgtgctcaagcatgcgtactaagaggcaaaatggcagattttaactggtatacaaccttcctctaggaacacttgactggtaagggaaaaacgcctcaaatgagaatgtgcacaacttcagtaaagacattgcacatgtggcccctcccaagtgctgacaggccactgcacgtgcagacagcccatgccaaggaaaaaatcaaaggagatacaaaacctcggaagcatgccaatgtataaaacgcaaagtcaaaagtcaaacagggcacctggatctctcaagttgcctgcttgcccctcttcctttggttcctgctctaaaactttctaataaactctcactcctgctcaaaaacttgcctcagtctctcactctgccttatgcctcttggatgaattctttcctttgaagaggcaagaatcaagttattgtagatccgtatggattcaccactgctaacattatgctgaatggtatgtgagagtagaaaaaaaaacactgttttttccctgtctctaataatgagcttaacatcagaatagaaataatagaagaaaaaaatcaaagaactggaagccagaatttactcaacctgaacaaaagaaagaaactagaatgggaaaaaaaagaaaaaaaagaacagagcctcagggacctgtgaaactatcataaaagatctaacatgggggctaaaaatttactccaagaaataatagctgaaaagttctcaaatttgtcaagagacataactatagaattcagcaatacagaaaaagaaatatacaacaggaccaagcaaggtttattccagggaggcaaggctggttcaatattagaagatcagtgtaatctatcttattaacaggctaaagaagaaaaacaccacatgcttatagtaactgatgcagaaaaaacacttgccaaaattcaacacctattcatgataaaaacactcagaaaaaaatagaaatagaggagaatttcctcaacttgataaagggcatctacacaaaacctactactaatattgtacctaaccatgaaagactgaatgttttccctctaagatcaaaagcaaggcaaggatgtctgctctcatcactcttattcaacgtagagctagacactctagcctgcgcaataaggcaagaaaaggaaataaaacgcatatagatctgaaagaaagaagtaagatctgtttacttatttacaggtaatgtgattacacagaaaatcccaaggaatcaacaacaaaagactcctagaactcaaaagtgaccaacaaattcctctttaagtaaagttgggtctctcacatgtaattgaaagagtcctttatttattcacatatccatcaactatttattgaatgcctaaaatttgccagtagctattccaggcaatagatacaccatcaaacaaaaagagttcttaccctcaagggtgatagtaagagatgtaaaaagttaaaaaatggtaaaagagaaaaaatgaagagtgctactttagaaaatgaggtaagggaagagttatttaataagacacctcagaaaatgaggaatttggccagggggatatctgaggaaagagttccagtcagtggaaactgtgaattcagaaagcctgaggctgaaacaggcaagtgtgtttgagaaaaagcaaggaggccggtggctgtgcagagtgaggcagaggaaggagaatgggctgtggatcagaggaccctgtgccagatcatacaactccttgcagttcatgtaaggactcggattttacctggagtggaaaaagaagcactgaaagatttgagcaggggagtaacctgatagcgtttatgtttagtcctgccacttcgacagataaacgcaccaatgggcttgatgagatttaggccaacccataaccgcccctcaacttctttcctttcaatttcaaaactcctctatggcttcctccatctgttcttccttctgagaagtgctctctctgcccctttacagaactaaccacttcggcaactccttggacactttccttcttgttaataatttgctttctccgcccctcaaaagcttgctgtttctgtaaatcattacctgtaagaggaaccgctgggagtcctgtaaactttagcccagagcttggctcctcctccagaatgtctccaccaatcaaggaaagtgttttgggccagtcttgctcctccggattgtcagactgctcctccctcttctttagactgccacgaggaaaaagcagatgtgagaactcaaggttcagggctgctcttctaagaaacaagtctgccataatctccatctgtgttggaatctgttaactagtgagtacctcatctcccctcctgtgtaagatttcctgaactggcacatctgttttttgagcaaagataacaaacagatgaacaaaaccaacaatcaaaaatgctgtcattaaagtcttgggcagccaaagtttctctcagaatttctcagttgtgtgatactatctattaagtgatgaggagtatgcacacacaaaaggctataaatgtagcagctgagttttcatgttgagccttttggtgctatttgattttttgaaaaactatgtacatgtattaagttgataaattttttttttaattttaattgaaccagatgcggtggctcaagcctgtaatcccaccactttaggaggctatggtgggcagatgcagatcacttgaggccaggagttcgagaccagcttggccaacatggtgaaaccctatctctactgaaaataaaaaattagccaggtgtggtggcaggtgcctgtaaccccagctacttgggagcctgaggcagtagagtcacttgaacctgggaggtggagtttgcagtaagctgagattgcatcactgcactccagcctgggtgacagaacaagactccatctcaaaaaaaagaccaggtagtggctgagattttcattgtactgtctgcttagctccccaccttgctcagtgacagatgggaatccatcttctgcatcatccagaaagtatgtaaattacttccaggaaactttgggaaacacagatgcaaacctaagagcagccagttttctcctttaggtggtcaagggcagctgcaaaagttctgtataggaggggcttcaggcagggtctggttgggtttggagacaacagcagtgaatttaccttgcgttgaggctgtatatgttaaactactgttattacttggatacttagagggagggatgtttagggagctgtggggaggctaaagcccccttggctgtagggacaaagagcttgcatttcagatgagaccttaaatactttcagaagcctatctgaccaggggtggtactgtctttcttagaagagttttccttaccaatgtttctgtggctcagtataaaaatctggagtcaccctgggaaagttatctcagcaattttacctacaaataattttataaacctgggaaatagaagttgtaaaatgctaagatcgatgaaaagggaggaaaagaactttgttgaggagaaggtaatcttatggttttgatgaagaggatgtcgatatttgctttttggtagaacagaatggttaggttcattttaagctccaaatgactgatcaattttcttttcaacatacgtttgaaggattctgaatgtggtgtagagtattgtatgggagctagggaacaaatcatactaaactctgattctattcagaatcagcaagctaagtatgatatatttatctccaatcatattaatatttacataattatttaatgtcttccttaatagtctataagcttcatgggagcaagaccagccgtgtcttgttcacagctatattttcagcatttagtacaggtctggcatataccaagtgttcaataaatacacgggtaatgaataaatgcgttgtccaatttaaatatgtgtgtctgtttgtgtatacttccttgtctgtaaaatgaaaatactaataaataactgcaaaatgcttaacagtacaaccacttgccagatctcagcaaaaatgttacgtccctagagagacctcctaaaaggtcccttttctcccattactctctttgttttcttgcgtaacatcacatttatttattcccttgtttactatatgtgtctttctatgagagcaaggaggaccttgtctcttgcattccctcctgtatcctctatgtctgaaataattcatggcaagtgattaataattgttgaataaataaatgaatcatgccaacctaccaagaatgaagctcaagaccttaagatatttgtccaaattcctgccttttatttaatagaatcagaaattgtttctaatacttcacaaccacttaaaaatactattcatttttacatccaagtaatgaaagaatcaggacgttccttttggaagacatagtttcaacattttatctaaattgcaaaattatacaaaaactcaagtgaccattgataggggaccggtttaagaaatgacagtgcagttcttcactagaatgtcatacaactgttaaaagaaaaaaatcagaacagggctgagtgtggtggctcccacctgtaatcctagtgctttgggaggccgtgtgcgtgtttgtgtatatttccttgtctgtaaaatggaaataataataaataactgcaaagtgcttagcacaggaggattgcttgaggtcaggagtttgagaccagcctgggcaacatagtgagacccccatctctaaaaaattttttaaaacacttagctgggtgtggtggcacacacctgtaattccaggtactctggaggctgaggcaggaggatcgcttcatcccagaagttcaagctgcagtgaggggtggtcgtgccactacactccagtctgggtgacagagtgagatccatcctgtctttaggcagggaaaaaaaggaaagaataaatgaataaatacttcatttaaaaaaatagaatgaagatctctgcgcactggtatggaaagcccttaaaaggtacattgttaaaaatgtttttagtgggcagaatagtgtgtattctgtgctacctgttgtgtaaaattggtggagaaataagaatctatactcataatttgcttgaatgcacataaagaaaccctgaaaagataagtagaaataataatagtggtttcctgggagtgagagcaaagtgggcagctttgagactagaggtgggaggcagatatttttttttccctctgtaccttttacagtttttttgagccatttgaagatattatgcgaaaaaaaattaaaaacagagagagacaagtagtgttgattacttaacttctttcagttgaaggaaacctgatgctaattctgttaagaggagagcagccaaaagcataggttgtgacttgccagcaaaaaacagggaccggggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaacagggaccggtagttccctctgtacccaatccccaatgccaaacagaatgacattgttagacttaaggtcttaacctgcagggcaactgggattcagagtgattttagttctgttcttaagagcagccttttctcctaaagcctgccaagaaatttttgttaattcttcccaggaacataacagacaaggcccctgctctggtagaacttacatcacagtgcaaagatcagcaaactgtagcccatgggtcaaatccagccctctgcctgtttttgtatagcctttgaaccaagaatggtttttaaattttttaatggttgaaaaaataactaaaagaggaacactaattcatgacacatgaaaattaaatgaaattctagtgtcagtaccataaataaggttttattagaacacagccatgccaaaatttatttatgtattgtcaatggctgctctctcaatggcagagttaaatacctgcagcagagaccatatggcccacaaagcctcaaatatttagtgtctggcccttcacagaaaaagtttgctgacccctattctagtagagagtaatatgcttggcaccatgataagcattttgcatacagtatcccattcagtcttcaggacaaatctctgatggaggttctattagtcgctccattggtaaaatgtgaaactgaggttcagagtgattaataattcaaataaggtcatgcagttcataagaggcaaaactgggagaccatatcacatgaccatatgactcagtagccagtgtatttaaccatcatgccatagactggtgcttttcacacttgaatgtacataccagtcacctgggatcttgttaaaatgtcaacatctaccaattcagtagatctagagtggggcctgagaatgtgcatttctaacaagcttctaggtgataaagatgatgatggtggttcacaaatcacagcctctaaatcagtgattctcaaccatggctgctgcacattaaaatctgaggacattttaaaaaatataaatgggcccagagcccactctgaaatattctgatttaattgatccaagacctaggcatcagagtatttttttttaatgctttcttggtgattcaaatgtacagctggactgcaaaccactgctctattgaaatcctgtcgaatgacagtaaaaacatttaatccaaagaccagagttctagttctaactctggtatgacagaatgaagcaggctgtttcccctctctgggtctccagttttctttgcaggtgaaaaaggaaaaagctgaaaccagatggtgtcagagggctcaagatcactgacttgtcaggtcttcacacacataaatgggaaggacagaagtacccaggtttcctgatgcatcggttatatcaacatgatgcccaaacaccaggtctgcttagggtaaaactgcaataactgtagatgtcagctaaactgtccatttagctgacatctgcaattatgtattgttttggcaatgtatcaatacagaaatgcttccacatagccagactgccttacatggcacacagctagaattgtagttagaatgatgatttaatgattatgagagtaatatatattgcattgtaggaaatttggaaaattacaggaagtataatgaggagaatctcaaacactcataatccctagaactgtatttttaacagcctcaaccaagtaaatgacattgtgatcaaatgatttcccacagaagcaggcgatggcccagaggggcctccccgacaaaagtcctaaatgttaaagccccattattacatctctattaaatgcagctccaagcctggacttaaaagtagtatgggcccctattgagagcatgggaactgcaacctatcaactagacagttcataaactgtgacagtgctttcatgtctaattgttattgggctactctcgatttcttcatctacagattatccactgtgaaaaatgctccttaacatttctaccctactttgaaatctgcaggtgaaagatattagacaagaagccttagccctttgctttcagtgagattaagtgggtgacccagatctttacttctttagaaatgcatatgggtgtcaatagtgcacagtattctggagaatgggctaggacctgatagttctgggttcaaatccagccaatgcctcttactagtcattttctcaatctgtaaacagagatgataatagtacccacttcacagggtttctctgaggatttaataagaaagtgtctataaaacactgagcactgtgtttggaacacagagtgtacgcagcaaatggtactatcatgatgattatcaatactaataacaaaacttagccactttggggtatggctaccttcaggacagaaacaaatatatgtcctttttgcttgtcttttagatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggtatggggggagggccagtcagaccacaatttctcaactgggagtgattttacccctaggtaacatctctaatgtctagaaatatttttgttgccatgataggggcagaggcagttgctactggcatctaacaggtaaaagccagggattctgctaaatatcccataatgcacagggcagcctccagaacaaagaattatttgacccgaaatgtcaatagttccatggttagttgagagaccctgtattacataaatgtagaattctaggttgacttaaaaaaaaaaaaggagaagagtgaaaagtaattccaagagtcagaaatggtagaaaaggaggcacagataaatctttggggaaaatgtaaaggatgcaagaattctcacttattggaaagaaaaatgatcaggctaaatgggaaatgatttgggccaaaagaaatgacatggcttccaacgtctagaaataaggaccccaaagttattatttttcctgttatgtttagttatgtaataactatacatagttatggggtacaaagatatttttgatacatgtataaaatgtgtagtgatcaaatgagggtaattaggctacccatcatcccaaacatgcatcatttctttgtgctgggagcattcaaaatcctctctcctagctttttgaacatactcaatatattattcttaactgttttcactctacagtgctatagaacactagaacttattccatccatctagctataattttgcatccattaaccaacctctttctatgctcctctccccactaccgttcctagcctctaatagccacaattccactccctacttctatgagctcttttcaggctggagtgcggtggtgtgatctcagcccactgcaacctccgcctcatgagttcaagcaattcttgtgcctcagcctcccgagtagccgggactacaggcacctgccaccatgccggctaatttttgtatttttagtagagacagggttttgccatgttggccaggctgaccttgaactcctggtctcaagtgatccgcccaccttggcctcccaaagcactgggattacaggcgtgagccacccaccacgccaggccgagctccttttttttttttttttttttttttttaagagacagggtcttactttgttgcccaggctgaagttcagtgaagctcatttttttaagctcccacatatgagtaagaacatgtggcatttatctttccgtgtctgacttatttcacttaacataatgtcctccaagttcatacatgttgccacaaataacagaatttcattcttttttatggctgaatagtattgcactgtgtatatataccacattttctttatccattcatctcttgatagacatttaggttgattccatatcttggctattatgtacagtgctgcaataaacatggcagtgcagatatctcttcaatagactgatttcctttcctttgaaaaaatacccagtggtgagactgctaaatcatatggtagttttatttttagttttttgagaggcccttatattgttttctgcaatggctgtactaatttatattctcaccaatagtgtttcagagttcccttttctccacatcctctcaagcatttgttatcttttgtctttttgacaatagccattctaactggggtaagatcatatctcatcatggttttgatttgaattatcctgatgattaatgatgttgagcattttttcatatacttgctgccaattagtatgtcttttgagaaatgtctattcagattctatgtccattttttaattgaattatttgttttgttttgttttgttttgctgttgggttatttgcattccctgtatattctggatattaattccttgtcaggtgaatagttcacaaatattttctcccattctacatcttgtctcttctctctgttgattgcttcctttactgtccagaagctttttagctttgtatagtcccatttgtctgtttttggttttgttgcctgtgttttcatatccttatccctaaaatatttgcctaggggagtctcagagcctactctggctcaggatctgcccaattttattaaatttattataaaatttaaaaaattttaaaaattaaaattaaaataaaaaataaaacatttgccttgatcaatgacttgaagcatttacactatattttcttcggttgttttatagttttgagtcttacatttaagtctataatccagttcgagttgatttttgtatatggtgagagagagggctctagtcttagtctaccacatatgattaccacttttcctcggaccatgtactgaagaggatatcctttcctcagtgtatgttcttggcacctttgttgaaaatctgttgaatgtaaatgtgtgggtttagttctgggttatctattctgtttcattggtctatgcatctgtttttatgccaataccatgctgttttggttactatagctctgtagtatgatttgaagttaggaagtgtggtgtctctactaaaaatacaaaaattagccgggcatggtggtgcatgcctgtaatcccagctactagggaggctaagggaggagaatcactttaatctgggaggtggaggttgcagtgaactgagatcacaccattgcactccagcctaggtgacaagagtgagactccctctcaaaaaaaaaaaaaaaagatttagtgttagttcttatggtagaattcagcagtaaaaccatccaattctgggctttttttattactgattcaatctcattacatattattggtctattcaggttttctatcttggtaggttatgtgtgtccaggaatttatccatttcctctatgttttccaatttgttggcatatagttgttcataagagtctttaatgatcttttgtatttctgtggtacagttgtaatgtctcctttttcatttctgattttatttatttgggtcttctctttttttcttaatctagctaaagatttgtctattttgtttttcctcaaaaaattttgttttgttgatcttttataattttgcctcaatttcatttatttctgctctgatctttattatttctttctttctactaattttggatttagtttgttcttgcttttctggttccttgaggtgcattcttagattgtttatttgaaatctttctgcttgtttgatataggtgtttatggctataaacttcccttcttaacactgtgtttgctttatttcattgattttgatatattatgcttccattttcattattttcaagacattttttgctttccttctcaatttcatcattgactcactggtcattcaggagcatgttgtttaatttccatgtatttgtacagttttccaaagttcctcttgttactgatttctagttttattccattgtggtctaagaacatacctggtatgatttcaatttttaagaatttgttgaaatttgttttgtgccctaacatatggtctattctggagaatgtgccatgtgctgatgagaagaagaatgtgtattctgtagctgttggataaaatgttgtgtaaatatctgcgaggtccatttggtccaaagtgcagtataaatccaatgtttctttgttaattttctgtctagatgatccgtctaatgctgagggtagagtgttaaagtcctgaacattgttgtattggagtctatctgtttacatctaatgatatttgctttatatatccaggtgcactgatgttgggtgcgtatatatttacaattgttatatcctcttgctgaattgatctatttatcattatataatgaccttctttgcctctttttatgttttctgacttaaagtctatttcatgtgatataagcatagctattcctgcacacttttggtttctatttgtttgaaatattattttccatctcttcattttctgtgtctttttttttttttttttttttgagacagcgtctcactctgtcaccaggctggagtgcagtggcacgatctcagctcactgcaacctccgcctcccgggttcaagcgattctcctgcctcagcctcccaagtagctgggactacaaggtgcacgctatcatgcccagctaatgtttgtattttttatagagacggggtttccccatgttggccaggatggtctcgatttcttgacttcgtgatccgcccgccttggcctcccaaagtgctgggattacaggcatgagccactgcgcctggccctatctatgtgtatctttacaggtgaagtgagtttcttgtaggcagcctatagttgggtcttgttttttatccatttagtcagtccatacagtccatatcttttaactggggaatttaaactgtttacattcaagattgttattgataggtgttattttgttcatcataagggtgccagcagtggctccagtgggtcccaggcaggctgatcctcaggctcccaggaagtgtgcatgggcactggcagtagcagtggtaagcctcaagtgagtcagacctcaggtcctttggcagtgcacatgggtacttgtagtagtggcagcctgaatgggccagtccttgggtccgcagatggcaatgcaggcacaaagcggctctgccactagagggggcaagatcatgttcatggcagcaggctcaggaaggcagctctcaggctctggggagtgtgctttagtgccttatgtcctggggcagcctctcttgatgtgctggactccctgttacctggggtgtagagtgctgtgtgtaggctcgggtgccagtggcctggctctatcactggatccacctggtgttggaatgctgcagccctctacgggaacgtgtggggatgtcagcaaggccccagggatgtggagatgcaggggcaattggccccagggcaagatgtagtatggtagtagctctgttcctaaaatgatgccatgctatagcagctcgggtcctggggtttgttgcaggaggacctagtatgaacttcctctctggaacaatgttatactatactagtatactatactatacagcgtttactaggctcagggcatgtgagggctgaggggctctcctgtaggtgggacttcaggcatctgtgatgggaatgtgtactgctgaggatcttccacttacattttcctcaaaatagggagtccctctgggctctgtgctgatcctggccagctgctcttcttccctctctatgctttcatctctagttttcaggtctcagagagttttgtcacttccttgctaaattccagtgttctccctttgacactctatttgtcatgttatctgcttactgtcttggtacttctggtaggaggtgagtactgggcatctctagtcatccatcttgatgatgtctcccccagagttatttccaaattctccatccatgttctaactaatgacttgcgaactttcttcagctaatctattccattgagtcagttggcccagaatttagctgtataacaacctttaaatcaatgactggtttttctttcctcaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacaggttagtaatgtttgctttccgatcatatttattactaagctggaggggagattttccagaacacctaagtaatcatgatacatttattttgttgtgggcttattgtcaaagagtgcctttaaattatataaaagttaggccgtggtaggctaattccttatccctaggtggaacatctttaaaagataatcttagagttacagcctcacaaaaattgttgtgttgccctgattagaaagaaaagatattctaaagaacctgtgttctggtcctggttgttggtttcttgaagaaccctgatggagaggcctggtccttcccaaagtgaaaggatgagccagtgtcaagagtccaggaatgccagacatgtgttccccaatcttcttgcctactgtgtcgcctgggaagagtaaaacctattgtgaagtgaatgctttccatccctgtcttaagggtctgggacttaagggtggtggggcccaggaggaagatctatatatttttgagagtccatttatcctttgagaaaataatacccaaagcttactgagcactgttctaagttctttacatattttaactcatttaatcccctaattatcctataaaagaagtagtattattacaatatcactttacagatgcagaacctgaagctcacagaggtgaagtggcttgtcccaagtcccagctataagagtgtctggctccaggacactcttaatcattatacttcatcttacagtgtaatatataaccagcaggaatagaaccacagaaaagatgaatgcctccacacttccttttggaaataaatcataaagcaatcatgtacattttaagaggcactcagctgatgtggtgaagtgtacagttctggagtcaggctacagggttcaatccctgcactgtcacttactacttaagtgataccttgggcaagttattcatagcttttatgttttggggtttttttggtggggactgaataagttaaaacatataatcaaatactcaataaatattggttaatattacttttcaatcaaaaccttcttcaagctcaatgttagggatggtcttcaaataaagaataattatccagtatttaacatgctttcatgttaagccaaaagggtcatagactctgaaatcccttgaaaggcaaaagcagataagtgaaagcaagataaatagatatcttcctggtaaactgactaactcactctgagaaatacagaatgtatagatggtatctacactactctaacataatgaagaataacatttcttctaaacactgtttcttttctgcccctttagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaagtgagtagccacacttgttgtaaaacagcttcccaaaaggaaaggcaacaataaaaagatattaaacccagcagtgattagaaaaatgcaaattaaaacaacaggcaaagggaacagttggtagttattgctgcactaatagtgctaaactctgaagtaggaaggagcttggagtgctttttgtaggttgggatcccctgagattggagattggtgtataggaagtttattaaggagttcttttgggattaacacctgtgaggaatgagtaagaatgtcggactgggcagagaaagaaatttatttgcgatgtattccctacaaagctttcagtcaacccactgggacctctgaaggacctcctcaaagctgttcccagctaaagcaagaggtcctggcctttatatacccacattgatcagtaattggatggggttgtccctaggagtcaagacctttaacaaagccactgtcttcagtcaaggcaatctctagagagtgctcccagcacctgtcactgaaggatcacagtcagtccttcagtgttggctatcccattcccttgctgacagcaacactggtatcaggttaaaagaaaaaatgcttaatgttaatggatgcaattataaaagtgaatttcactgatgttgaagcctagcatggggtgtttccatgggttacttggaactcttgccaggtactggttatgccttagaattgggctggcagcaaagtccttctctagaatgagcttcctacctttactcaaggatttgggagcatgcttgcaactatggacttttcctaccacatttaaaattcctaatattgagttcttgccaaaggccaagtacggttctaataaaaataatgttataattgcaatcatagcttatattgatacggttatgtgccagaaactattctaaggacttcagatatattacctcatttaaacctcacagcaacctaggtactataattacacagctgaataaggtcaaatgctagtatctggcagagctaagtttcaaacccaggcagtatgggtgctgagcctacactcctcacttctgtatgtactgcctctagtaagagatcagtacaacaacccttcctcaggttttgagggcaaccgtattggtgatggaagtgataggaacacagctatagatacttttttttttttagacggagtctcactctgtcacccaggctggagtgtagtggcgcaatctcggctcactgcaacctccacctcccgagttcaagcgattctcctgcctcagccttccaagtagttgggattacaggcacatgccactatgcccacctaatctttttgtatttttagcagatatggggtttcgtcatgttagccaggatggtctcaatctcctgacttcatgatctgcccgtctcagcctcccaaagtgctgggattacaggcgtgagccactgcgcccggcctatagatagtatttttaattaattaagataattatgaaatcatagactgaacacttggtgtagctttgtcagattttgaaaacagctttttagccaggcgcagtggctgatgcctataaatcatcactttaggaggctgaggtgggatgatggtttgagtccaggagttcaagaccagcttgggaaacacagtgaaacctcttctctatataaataaaaataattagccaggcatggtgatgcatacctgtagtcccagcctactcgggaggctgaggtaggaagatcgcttgaacccaggaggtcatggctgcaatgagccatgactgagccactgcactccagcctgggtgagagagagagaaaccctgtctcaaaaaaaaaaaaaagaaaagaaaagaaaagaaagaaaagaaaatagcttttctatatttctcatgaatggcctggttgtttctactcattctcaaccccacatgcctggataagtctgtgtgcatcttagacacttgatatgtatgtgtgcagctgccctaatgtgtgacttgtatagaagtctgattatcctttggaactaaaaggttttctttctctttaactggaactctttcttccctggatggatgcttagatcctgttcaatcttattgtctgctatatccagaactatgtagactctcttgtgggaaacagaaaagccaacctttcacggtcagcaaacttttttttttttttttttgagacagagtctttctctgtcacccaggctggagtacggtggctcgatcttggctcactgcaacctccacctccctggttcaagcgattctcagcctcctgagtagctgggattacaggtatgtgccactgtgcctggctaatttttgtattttcagtagagacagagtttcgccatgttggccaggctggtctcgaactcctgacctcaggtgattcacccgcttcagcttcccaaagtgctgggattacaggcgtgagccaccatgcccagcctcagcaaacattttctgtaaaagggacagagaataaatacttaaggcttgcaggccgtatagtcagtctcatcacaactactcaactctgccactgtagtgtgaaagcaaccacaggtactacctcaatgaatgggcaataacattttatttacagaaacaagaggcaagtcagattttgccagtaggctgtagtgtgttggcccatcagtacccatggcttttactaacatgtattgtattaacatactcatttttaaaaaatcacattttaaagcatccataggggagggaaggggaaaattcttccttatccatgattgcaagatcacacagactccttactctgctggaggtatgataaaaatctcaagttttaaaaatgcttcaatccttctttatcatagaataaaaagctaggaaagcagctattataaatgggcctttgatgacaaagtttagttttgattctagaaagcacctaaaaggatagagaaagtgatggcttttaccctgtaattcaagctaagccactggcacctgattcatgacatgaagaggttcaagtggagagcttctcaaaatttttcagtggtaacagtctgtgatgctgtgtttaacatgcagtcattgtagtttttcctttgcagacatgccagtgacagccacacctgtgtgaagacaaaacacaatgagatcatggccatattctttaccagtggaacaagtggatatccgaaaatgactgcacacacccacagcagttttggtttaggattatctgtaaatggaaggtatactttcacaaaagtgcagcttgaagtgtcaaaactgcaaagatgatgacttatgtactggtcttttatatttattttcctatgtacatcagggctactctttgttttcccaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaagtaagccaaagcacaaagaggtcaatatttagaaatgcattaagcagtatggctgacagaactggtgaataaagcaacttgcagagatcagagtagacaatatgatttaagatatgtcacatccagaaagtcaataagcctgaaaagatacactcggccccctctgtatccacaggttctgcagcctctgattctgccaggcacatattgaaaatatttggggagaaaaaccaaaaacaaaatacaacaattaaaaaaatgcaaataaaaaataccatgtaacaaatatatacatagcatttacattgttttaggcagtataaataatctagagatgatttaaagtatacgggaggatatgcataggttatatgcaaataccatacaattttatataagggacttaagcattcctggaaccaatcctgcagacactgagggatgattctacaagaaaaggtaagaatgtatttacattaacataaacaatgtttaaattgtgctgcgtcaaccaaagacatttaagcacttatttaagttgtagtaagaccaagagtttgctttttctaaattgcagacactctccaagtaccccatcacagtcttctgttcagcaccaactgtataccgaatgcttgtacagaatgatataaccaggtaagaaatgttagtaaataggcatctagtggggagaggggagaagaggaagctataaaataaaagatctttctgcctgaaacatagctccaagccagtagacacaggatttagcaatctctcctcttcctctttctccttcttgcctgcattctgtaaatgataattactgtgaccagggcaagatcccccaaacaagaagaaagtgagggttcagctatgtttatagctctaagcccagtggttatgggtaagaagatggtaaatcttttggatgatggctttctctgagctgagaaagtagagaacttgtttctatttggaaccttatcccagcagatagaaaagaggatgcatatcttttattctattgctgattccatttgaaagggttcattggtaatccaaaaagaaaaacaacccccgtttctctttgttttgtttttgtttttgttttgttttgttttgtttcaatagggttttgggaaacaggtggtgtttggttacatgaataagttctttagtggtgacttctgagattttggtgctcccatcacccaagcagtatacactgtactcaatgtatagtcttttatccctcacccacctcccaccctttccccagagtccccaaagtccattatatcattcttacgctattgcatcctcataactcaactcccagcaaccactattttactatattcacaacactcaatactctgggtctccagatgtaagggatcttttcccccacattgaccaattctccaacatcagttgagtatcctatgatttaattcagtctgacattatctccgtggaggcagcatcatatcccacaggttaatgactcagtcccacaagactctttcccatctcaaatgctaatcacaagtccaggctgtcacctgcgcatatgaccaaatggctacaaatcagaggttcccatgacccttccttgggtttagtaatttgctatgatggctcacagagtgcaagaaaacacttacttacatttcccagcttattataaaagatatgataaaagttacagatgaatagctagccagatgaagaggtacatagggtgaggtccacaaggtcccaagtgcagcagcttctatccctgtggagtgggggtgcactacctttccggcacgtggtgctctccaaacctcatacttcagggatttttttggaggctccattatgtaggcatgattgattattaagtcaatctccagctcctctcctttccctgaaggatggaggtgaggctgaaagtgccaagcttctgttcctggcttagtctttcttgtgaccaacccctatacgggagccccattgagagtcgcctcatgagaacaaaagacaattctattacccaggaaattccatggaatttagaagctctgtatcagaaactagagtcaaaggcaaaatattagaacaaaagatactcctagcacacccatcacttgggaaattacaaaggttttagaagctctgggccaggaacccaggatgaagactcagtacaggttgagtatcccttatccaaaatgcttgagaccagaagtcttttggatttcagattgttttggattttggaatatttgcattatactggttgggctgccctaatccaaaaacatgaaacctgaaatcctccaatgagcatttcctttgagcatcatgttggtactaaaaaagtttcagattttggagcactttggattttgaattttcagattaaggatactcaacatctatgtatttcttgttatagctcatatcacaggtaaatatatttaaactgatgttatttaattatcgaataggaaataattcacctgccataaaattcaaaaggtatataaaaatacatagtgaaaagtcttgcttcaaaccttgtccccagtgacccagtcctcttccatggaggcaaactgagtttccagtttcttgtctattctccctgaaaatacacaaactgatacacatgtgttctccccgtctcaatttttttttttttgagacggagtcttgctctgttgcccaggctggagtgcagtggcacaatctcggctcactgcaacctccgcctcctgttcaagcaattctcctgcctcagcctcctgagcatgtaggattacaggtgtgcaccaccatgcctggctactttttgtatttttagtggagatggggttctgccacgttggccaggcaggtctcgaactcctgatgtcaggtgatccgcccacctctaactcccaaagtgctgggattacaggtgtaagccaccacacctggcctttccttctctattataaacataaatggtatcacaagattcacacagttctgcaccttgcttttttcctctaacaatacattctggcactgtgttgtgcaatatggtagccactaaccacagctagttatttcaatataaatattaagtaaaattaaaaattcaattcctcagttatactagtcctgtttctagtgttcaatatccatatagggctagcatatactgtagtgggtacagcagattacagagtacttccatataacagaaagttctactgggcagcactgtccaagagcttcctcatttttcatagctgtatagtattccattgtataaatatcccaccatcagttttaccaaacaattggtacttttcattgctgatttaaagtgttattatggtgctcacttcagcagtacatacactaaaattggaatgatacagagcagattagcatggcccctgcacaaggatgacatgcaaatttttgaagcattccatgaaaacataaaaataaaaacaaaataaaataaaatgttattatggggtaccttccctaagaacagaatgaccttctttgtaataaattatacctccaccacaaaaaggggggtaaagaaaaactagtatttggggtattctagtatcattctatgatattagaatgatttatctttttaatatctttatttttaatttgtgtaggtacttagtagttgtatatgtttatggggtaaaatggtttgttttgtgctagggagaggaattaaaaagcgactaaaacattttatattgaagttcataagaaataatccttaatcttcacttctctccatttttcctcctaaatctaacttatctggttttctgagaagctataagtttaaaagcttaaagcactgtgtgagtgctggggaaccaattacccctgacgtgactgaaaaatggagaaacaagacgggcctggatatctacgaaggatatggacagactgaaacggtacctgacctcactgaaaagacatagctggattccatttagtcagatgaataaaaaccaaagtgtccacagtctccttatgattatttgagggataggagttgagtggttagaaaatgtttaaaaaaacaatgcttgcaagaacctaattgcaaaaaagctctgttaacagatagttgtttaaatagccattcattgacaaacaccactgttaatggatcagagtaagggcattacaatatttttttaaatgaaataatactggatctactgaaagaaagaattcctcccagtgtgatagggaagtatcttatttagggctgcctcaaaatggaaaatgctgagatccttgctgcctgaaatattaagagtttgctggacaactccttagcaaccatactctaaaaaggattttttaaagagctcatagagataaggaataagaaattctagaggaaatgaatgaaataagaacaaaaaatgaaataagaacaaaaaatgaaataagaaaaaagaacaacagtggttattttgtagaagagggaggagtaagatgaaatagataagggaaaagttgaaaaaacttttcacaatgtgtctttataatgcttcaatttatgaaccatgagaatgtatcacctggtaaaaaatgaaaatatcaaaaataaaaatcaaaaattgaaaaattcattaactagaaatagcataacaagtatgctaatataaatgcaaatgttaatatactcatgttttgataaatacggatatatgagtaattattgttataactatattttatacatatgcatgtatttatatgttatcactacattccatgagagtatagcattcattttgagcctagttcatagtaagttttcaataaataatttgttgaatgaatgcatgatagatgaataaattttaagtgacttgtaatgttatcttactttttcttcttcttaactaggtgctaatctgtggaaattttaagggaatgaaaattaaacctggctcaatgggaaaaccttctcctgctttcgatgttaaggtttgcacatccccttccaggagaatgtttaacaacccaatctgtacactacctacctaccgcttacccccatataaactttctttgttatgatggtgattccattttacttccatgatactttaatttttataaatatgtgaaaatgattagaaatgttagcttcttggtctccattattttgcaaatacccatattgtaccatacagttctaagcatttaataaacgttaacccattaggctggatgcagtggctcacgcctgtaatcccaacactttgggaggccaaggcgggagcatcacttgagcccaggagttcaagaccagcctgggcaacaacgtgagactttgtctctacaaaaaaatataaaaaactagccaggcatggtggtacgtgcctgtggtcccagctactcagaaggctgagatgggaggattgcttgagcctgggagcttggggctgcagtgagccatgatcacaccactgcactctaacctgggccacagagcaagaccctgtctctaaataaataaatattaacccattgaatttccagaagaaaccctatgagaagcatactaatattagaaccattttacaaacaaggcacaaagaggtaaaagaactcaccagaagtcacacagctaatagctgctagagttgggattcaatcccaagcagtctggctccaatatctgcactcttaaccacaacacaacactggtcctctcaggcaagggaggtcaagaccttctgagcgggtcaactaggcccgaagaggcttcagtttacagtggctgcagcactttccctctctgctcccaagcctgcctggccatttccagcctctctgtatccactgccactactaccacctgatgcctagggggaattccagttccccatcagcaagctttatatagggttaaaattgttctcagatcaaccgagcttcaaagctgggtgtagccaaaggaacttaacactaatttggacactcctcaacttatgatagggttatgtcccaaaataataagtcatcataagttgaaaacatcctaagtcacaaatgcatggctgactgggagctgtgacttactgttgctgcccagcatctagagagaaagatggtttcaactgaatggttatctttttcacccattgtaaagttgggaaatagtaagttcgaaccattttaattcagagacccatctgtacgttaagagacagcaaaagcagcaaaaatatggatgaattaacagagtacagctcttagataaatgtttcccaagcttgtttgatcataaacatcatatggatatctgttaaaaatactaattctcaggcccctggagagaccaattcaatagatttggagtggaactctgaaatttgaaatcttgtgattttaacaagcaccccccaagtagtttttaggatcaaataagtttgagagagtttagatgagcttgattgctgctgtaactctttatagaataaaccagatcctgggtcctttctctcactttaaccttgctgtggaaacctggtctcaagataggatagcctagtggttcaactatatctctgctattcactgtctgagtgtctgtgggtacactgttaaagctctgtaagttccagtttcctaatttgtaaagttgggactagagtgaccaacctgtctgtttgcctgggacttatctggttttagcacttaaggcaatacatcctgaagaaccaccccccgacaacccctcaccacttcagtctcagatggttggtaaaccaaataataacagaactgatttcataggtttcttgtggtgattaaaggagacaatatgtttaaagagcatatcagaatgcttagtacataataaaggtccaaaagatgggtactgttatttacttctccctcacattcctctttttatttatttatttatttttttattttttcacattcctctttgaaaagcttatctaagaaaaaatggtaggagagcccaaacaggcttaacaatagtttgttggttaacaggctaccttaggttgaagaaagaaatattgataattaagcacactcatgtctgcattacagggaagttgatatgtaacacagctatgttctttttcttccttccttaatagcaattcccaacatgcatggctatcagggtcttacaggcacagctgtattcacagtgatcccaactgcaaggtacccccacctgctccccattaatttgagcccagtggttttctagagcagctatctttgaatgcaaatatgatgaggctgagaggaaaacagtactttttctgcatccccagtcatttttaactcttttccacgggccgttattatggggcttcttgttccttagctaagggcatctgcagtaacattctggcatctggggatgtgttccaaccaggtgaatatcagattcctacaacttcaaagcccaacctttataatcttctttgtttgcttttaaatactcataattttcatgtttaaacattttaagaccctatgaacaatgaggaacatgattctccccagacacagaagattttatctatattcccatctattaaaatctgtaagtaactggaacttttaaaatacttcctttccatcaataattccttcatacctggaaccacatatttctttagataactgggtgggaatttatatttttttatttgcaagagcttaaagagaagtttttacgcttagaattcctttgccatttaagtttctcattcagcacataagcccctttccttttggaaagtgctagataagtattatacttattctccatgcaggccacacctcaggtttgaaggtatctggagaatatatataaaagcagaattttgatacttagaaacagctaaaagtcatttagagcaaaatctgatgtataaaatcagcaatcaacttgagaaatgctaatctgatttttttaattggattaaactctctagaggcattgcacagaggagtgtaatgattaaaagcatatgatctggagtgtaagtggtgagatttggattccagctcaatcatgcacagtgttaaactctctacacctcagtttcctcatgtgtcaaatgggcataaaaattctaaccacatagggctacagtgaggaataggtacatgtcaagtacttaaaggtttagcattaattacttagcatgtattaagtacttaataaatgctagctactggtagacacttcagggaatgatgaggattggagagagggtaagagagcaaggctgtggcttacttaccattgtcaaccagagaatattccccttttcctgtttactcatattgggcttctgaagtaaggttctgtaggttccacagctaaacaaagtttgaaaaccagtaatgaagatatttatttatcaagaggaaaagataatcaagacctattgctaaatgataaaagcaggttggcaaaactgtatattataaagcaactctatttttctttttttttttttttttttgagatggagtttcactcattgcccaggctggagtgatctcggctcactgcaacctccccatcccgggttcaagcaattctcctgctcaacctcccaagtggctgggattacaggtgcccaccaccatgcctggctaatttttctatttttagtagagatggggtttcaccatgttgctcaggctggtcttgaactcctgacctcaggcgatccacccgcctcggcctcccaaagtgctaggattacaggcatgagccactgcgcccagccagcaatcctatttttcgatttatctatattgtctcaaaggatattaccaaaatgtgattattgctggatggtaaaatttttaaaaaattttatcctgcgttcacatgttggtaacctgtatttaatattttatgcaataagaatttaagtaaatatatttctcttaggaatttaaagtatatttaaaatatttttgggccaggtgcagtggctcatgcctataatcccagcactttgggaggccaaggctggaatatcactggaagccaggaaccagcctgggcaacataatgagtccctcatccctacaaaaaataaaaataaacattagctgagcataatgacatgtgcttgtagccccagatacttgggaagctgaggtgtgaggactgtttgagaccagaagtttgacgctgcagtgagctatgagctatgattgcaccactgcactccagcctgggtgacaaagtgagaccttgtctcacacacacaaaattttttttaagtcttcatttttaaatggcaaaagccaaaataaaacttgcaaagttaatatttaagctgcgacattaaacaaaaatttccttaaataaattgttctattttatcctagattgtagatgtaaatggcaatgttctacctcctggacaagaaggagatattggcattcaagttctacccaaccgaccatttggcctttttactcattacgtagtaagtgacttactaaataatctcattttctatttatttctcaagtgcttggtaacaatccctgtttgccacaaaacatacctaggataggtacttgaccctttcttgagagattggttgtcctgaatagtaatccaaaagacaagaaattgaagaaatacccaaattcttgctgaagaaaagcatgctggtcccctgaggccagatcactgttccaggtccacgaaggcaagaggaagggaccctagaaagaggacagcctcttaacatcccctgatcctctcaattatcaaacaaaacccactcattttcctgaaatccagttagtgctctttcttttcgggaagagtgagagggacaggggatgcgggggtggtgggattaagcaaatgtctttcacaagaggctttctaagctccttactgtttacaacaatattttcatctctaatcacagtatacaaattagagcaaagtctctatcatataataaaagatccagatgctacttgccagtgtatttgatataatgtaacagtatcttgttttttcttatgtcagacttgcagaaccaattctattattgtgtaaaacaaaacaaagcacaaaaacaaaacaaacctgtctgctctttattaggtgtcagtgctttcttttgactcttgagtatttacttctctcttttcctaccagcattatctattaatcaattagcaaaagacttaatttagtttactcctctgagctactgcaatatttattttgtaatctatctaagaaaaatctcaagatggaaacatgactaatctttgtaactgtagtttacctttcttctgtcgggctagctccatgctggaatttcatctttattttcacaatctatctcttcctaactctaatgcttctcaaaggagccaaacttttctgcttccttgaacatttaaaaatccaattgagggccaggagcggtggcttatgcctgtaatctcagcactttgggaggccaaggtgggcggatcacttgaggtaaggagctcgacaccagcctggccaacatggggaaactccatctcaaccaaaaaatacaaaaattagccgggtgtggtggtgcacgtctatagtcccagctatttggaaggctgaggcaggagaatcgcttgaacctgggaggcagaggttgcagtaagccaagatcgtactactgcactccagcctgggtaacagagtgagactgtctcggaaaaaaaaaaaaaaattccaattgaccagaagagttggattcaccataacaacaaaatgctatttgttttgcaggataatccttcaaaaacagcttcaactctacgaggcaatttctatatcactggggacagaggatatatggataaagatgggtatttctggtttgttgcaagagcagatgatgtcatattatcctctgggtaactttcttttccatatgtgcatatgtctgtgttaactgatcatcagtgttctagagtgaacctgccactcacctgtatgtattcctgccatatgtgtttctagctatcgaattggaccatttgaggtagaaaatgccctgaatgaacacccttcagttgcagagtcagctgttgtcagcagcccagaccccatcagaggagaggtaaaagaactgattcatgtcaactttataatttgttggcaatttaacacatacttacaaacagtagctcagtgaaacagaattaaccaaatgattcatttactaaatatgcaagtcagatagaaatatgctagtcagaaagaactgctacaaaataagattgaattatgagttgcagctctgatcctaacagacaaacaaaataaggctgaaaatacgtactagaaagaatttgaattccttccgtggtggactagggcaaagatggtgtgaatgccagtaacccaggctcacgtcaggatggggtgacagaagtcagctggatgggatcaaattgttacccagaaggtctggaaaccaacgaggtccctggtgtagtgaaggagaatgggctggcatcagatgtcagaagtgggaaccagaggctggaactgaggtaaccataagcagtcttggtaggtaaataagtagagatttcaggaaataaactctgaataacacaggtgtcctgaaagcccattcctattggggctgaccacacagtattttggcttaaaagtaccatgccaggcagcctcctgcgttttgcctgtgtgtctacaacatgcccctagggtttctctagctgagttacaagttctcacaagtatttcttcaagccatatcccttctaacactgaatccaagttttgaagatgacactgatgtcaatacaaatccagaactttctgtaccatgtattcaagctccttatctcaaatcctaggtatagggcttcaagcacagggcacagggcagagttagaaggtatccaatctcaggggatgaaataggtcctgaagtttaaggcaggccaggcacagtggctcacacctgtaatcctagcactttgggaggctgaggtgggtggatcacctgaggtcaggagtttgagacaagcctggtcaacatggtgaaaccctgtctccactaaaaatacaaaaattagccaggcatggtggcacacgcctgtaatccctgctacttgggaatctgaggcagaagaatcacttggacccgggacggggaggttacagtgagccaagatcgtgccactgtgctccagcctggctaacagaacaagactccgcctcaaaaaaataaaaataaaaataaaaaagtttaaggtaaaaataggagatgtgcatgttacagtggagggtggatctccccccaggactgattcccctaactgatctttgatgccagaagataccctgttaagtcctcctggatggcccaaagttgttccagatatagcccagtggctgggaattggtagtttgtcaagttgctaggatgacaatcgctatttactgtgaaagggtatattccaggcagctgagggcagggaaaacagtcagtgattattggcttgtctctttgctctgaacatcatcggcaaggtttcacgagtcttagctcttcctgtacttctcccctaccattagtcatcatcagttttacccacctagacaggtgcttactagggacaggatggtagctgagcctttcggaacagggttagcttggcagccacctgatatcctagcgtacaatataggaaaggtctataagtgggttgtggtcccctcacagctccgggggcttggcatagggcttggattagtcagagtgagggggaaagtgtggccagttttccaacagtggtaggctgcagcatttcctagtagaagatgtgagtgggtatctcaaacgaggtatccatgaacaaaacggccatgtgctccatgcctccctttctgctgccaggcctattctacctgggttaggtccttctctaggctgggtcctgccaggcagggtaattgggtagcaagttccagaattgattaaaaagaatatttggatttgaaataccattttaacattggaatgtgaaagacttgtggaatatgtgtctagatcactaggttcttaaatttttgggatcacatatctctttgagaatgtgaagaaaaccataggccactgttaagacttatgcagtgatggaaatgttctatatttgcaccatccaatgcgatagccatgcatggctatcaatcacttgaaatgtggctagtgtgactgagagtatttaatcttatttaattttaattgatttaaattgaaatagacacacgtggctagcagctatcatattgaatggcacagccatagacttttctcagaaaaatacaagattttgcatagaatttcatagagatttgaagcccacttatggattctgggttaaaaaataagacccaaacttcttgtaattctaagactacaactaagagctaatgtttttgatgacttactatgtgccaggcattatacatctatgctaattcatttaatcatcataatctcttttacagagaaggaaactgaggcacaaagagattacctaacttgtccaacattacacaacaaactgtgacttgaacccagctgttctgacttcagagttcatactcttacccatgttaggttgttccttgttaatttaacattttctgcagtagtttaaaaagataaaagagactatccaagttgtagaaatcgtcaatatgtgaaccagtattgcagtttttaaaataatttacctttgaatgactcacttacaacaagcataattttttaatttgtaaaaatgttaatgcagcagagctagcataactacaaatgcattttataaaatgtcaaaaagtgaatggaacaaaattatatccatagacacacacacacacaagggttcacaactgccgcatggcacatgtaaattaaaaatgttcaagtgttgttgttgttttttttcttagagacaaagtctcactatgttgcccagtctgctctcgaactcctgggctcaagcaatcctcccacctcggcctcccaaatgttggcagtacaggcgtgacccactgtgcctggccacaagggttttgggtaaagacaaaaatgggtaattgttcatacaatgtaaaactgcccactggtgaacagttttcaatatgtgaaaaaattataacttcaagtctttgtttctcaccaaatggctgtcctggtaatttgttgtttcaaataattccttttcaatgaaatctttactcccagatcaaagtggataggaaatgttgccagcttatctttaagctggacaaacgaatccttgaatttaataagatttcaggcacctaagtgcaggatacttaatcataaaaaagcttcaggggactctcctggaactgtgcctacagggaagcatcattccatagccagctccgggctggtaatctggcgttggaggtacatactagttgatgcacctagactcatgcctctagggaaggcagtaaatggcagtcctggtagtgccctaggagagaaaatgacaggactccaaatttacttttaaagggggctatgagggatggcctatctttctgtcttctccattacaggtccaaaaactaggcagagttttcaaaaacatttctaggaaggataaaatttggagaagaggatttgtaagcataaagtaataacatctttcttggcttctgccagttaaaggccaccatgatttccactcttgttcctcagggccatggaaatggatcagagcaacaaaaaaatagctgctggaatcttcacagccttgtataaagactgcatgttctctgtgaactgttcccttcaacaaagacatggcaaactcagcgtgactactgtttataagtaatcccccatgctgagggctaggctggatgaggctgggttgttacaggggtcccagaagctctcctgtattaggtacagaccaggaagtggctggcttaagagcacagagctgggatcaaactttattaaaacacactggcccaccccaccaggcatgtagattctcagagcaagcaaacaagacatactaaaacatacaaatgcataactcattttcctggtgtttcaaatatttattttaggtagtaaaggcttttgtcgttctaaatcctgattacaagtcacatgatcaagaacaactaataaaggagattcaggagcatgttaaaaaaactacagcaccttacaaatatcccagaaaggtaggcatcctaattataacgaatatttgctcagtgttgtggacaatttcaagtgtttatttttacattttaatgaatattttcttcacacatgctgcaccacatgtcccaaactgaactgatgacatatgggtaagaatcagaatctttgagattaaaatgaaaccctgaacctattttgtttggtcctttggcttactggactcacagtaaatacttaatatcaagacaactttcctaacaatacccttttccctattttggctgttacccaaaacccattccaaagactattctaattcttccacctagaattcataatcaaactgctatataattggctttatgtaaagataaaaatttccaggctaattttcttccccttgatgccaacaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctccacattagtgtcaatgttcctatcatttcttaatataaaaataataccatcaattgctgattaatttttaaatgtatagtatagaagcagtttctgaaccagatctctgctacataggttttcaaactttagttgactaattcttctgatatgttgatatacaaatcagaaccaatgttcaagcctgaaataaaactaaagaacttataaaagtttttagaaaaatataaaatatcagttagaagattatgataatctcaaagtacaagaatctacctgaaaatagactagggatttttattagtcacattttttgcaaataatttaaaaatagtttagacttgtttcaaggtctaactataaaagaaggatcatatactattgttgcttattatatgtaatctaataaatactgtttacaaaagattacacttgtggttcctgaagaaagtatggtaaatgcagtaaacattaatatataaaataaaaataaaatagtgtaagatgttatcagaatactcatgtttggaaattcaaggaacaattaggattcatacatgaaaggttatcaattcctcattgaaggcctgagtctcaaagaatttttggtggaaatacttaaatttctgtcacaaatatggcttgtttctggagaactaaaagtgagtccccctgtggaatgagatggaaccatgctgttggctctttccttttgaagtgtttgttcccatttgaaataaccacaacattttctgttttcttggtatttcccgatagggcaacaatagaagacttttccatggttcggtccattattagaaacaacaagtctcttagatctccgaccacacttgcataatggaggtgtcattttcccactcttccatggctcttgtaggttaactgtagaagttaatatagatgggagacgcctccaggaagaacttcttactggggagcaatcagatgatgtaggcttttcttcatgaatagtgaagggttgtttttttgctggtgggaaagcttggggactgcatggattccttttggtaccacctgaaagaagaggatgtttccccaaaactaaaggatgagacatattggcattaactctgttgaaggtacttgatttgtgttcaggtaacttaaaggcagaaatatctgaacctggatctttggcttcttttacattataaatagtagtgtgaggactcttgtacacaatagacttagaagtctcagatttttgaggagtttcctctatgtctccaaagttttcatgacttgacatttccaattctttcaaaaccattaatctttctccagaattaaatgaaatctctaagtctgagtcactaatgggaactgtacagtctacgttttcctcaggctgagatgctggcagtaaaaccacatcctcccaatcagccaacacaggtaaacagtccagagtagagctcatttccaaatcagaaacatgatgaacagttggaacggtggtagaaacaagtaccaattctgaaccaactgttgaagccttagatttggtattaaatgcaagatgttcattttttccttgcttttgcatatagataggtgaattcaaggtaggagactgcaactgccccacagaagtagaggacttagtattaaaaagaggtaaggaacttttgacattgtgaagacttgcttttatattgttttttacttgtaattgatcctgttgtgcctttataggagaatttgcacaaattgacttcatttgaactttttcatgaggatttattatatttttaggctccttattatatatgctgggaccctggatgctaatgttacaggcagacatttcttcaacttgaattgtattcaaatttctggccagaatgctgaaattcttcttagtgggaacctatgattccacagacaaatgcaacagctttagaaactgtgcattcgttaatttcttcagtatacagttttatgacaaaaaagagaaatgtcattgatttataaatgactgcacacattaaatctacgtttcaaagaacgtatgactgtttatgaagtttgagatgacagaataaaaaggcaagacactactaaccttgttcaacgaccttgtaattttcattacacaaccatctctgatcattttccaagcaagaagggcagtattccgagaatcgtccaaccctgaggatacagatatcaaacactgaatttagtggtactagtactatttccttagtactaaagaaataacttaaaaagaaaaacaccacttgtgtagaaattggaacacagttttagttttatgaccatctactaattttaatcatgataaactggtcttggaagtggaaggctatggcagcattaccagtgaaagacaagctcgtccacatttatagaggaggatatgaaaatgtattagacagttccccaaaatgtggccagcgttctgcaggaaccaggatttgtgaataatctaatagtcttgttcagttttttcactagtccattctattatttgagcacttgtttaatctccatttgatttggctcattcttttcattcttcttagcaactagaaagccactagatggcagtgtatcttacaatagtttatgaaagtggtaatttgaaagtcttagaaacaatgtgaattgtttagattaggagttttttttttttaggctgaagatatcccttactaatgacattaccaaaaaatgaaattcatatgaagtattttttaaaagtcaaatggcttacataatttttaatgtatactaaccagaatgttctcgtcctgagaattctattcctacttcctgcaaggcaccacttagtccttttggttttctcctatagaaaagctaaccaataaaaaaagatatatttaaaagaagattactattttaaagactatgtattaaacacttttcataatttttagttctattagatttagaatgtgcttattttttgtgtgttgtttttaaatactttaagaaatgcatttatgtgaccagtacaaaagaaagtatcttctttgcagaaacccatgcccatgtgtaggataaaagttaatcatttttccatagaaaaaagtaaacatgcccccattttttaccattaccttgtaagttgctctgagatcaatccaagaatttaaaaacacaggttttaacagctgctttcttttacactcatactccaggcaaacccccaagtcccagtctgcattaggtacattaaaatagaacaaagtcaatgatgccagcattttttacttatgctgccaccatttacaaatagaatgctagaagatcatataaaatagaacagtatgatttcattgctctgctaatatctaaaaattattcactttatataacttactattaacaagttaggttgatgactaaatttcaaaatgatttcttaaacacccagtaaaaccttatttcagaaagaagagtaacatgttaaattacaaggactatattttctatattctaggaaaatattaatgttattgagaaaccaaacattttatagtaactggaaaccaaatatgactatcaatgctatcttatcaatgacacagtattgctattaatgactattaacagcaatgctctaacacagtcatacaaaaaacctactttaaatggctcattttttttttcttttaagtgtcaaagcataaaagcaaaggatgttgagctgatgaagactgtagaaaatagcataagagtgttcactaaatcatctttgcttaattcttaacagtggaactctagaaacatttttttaagttcaggcttaatattttaaggtatcccaaaaggttaatttaaaaaatatgtattaatttacttttcttggctaacatctgctaggcatttaaattttttttcctagcccagaagattaacaaacataattctaggttagcaagtataaaactagaaataaagaattacatagtggtaatgctacccatctgtgattaataggtataacttattctttacctgaccaagtaacaaatgcacataattttacttcagaagcagaaggctctgaaatcccagtagcaaaaataatgttcttctgttgctgaatcttatgaatccatttacagaactgagataagcaaatcttcagagggactccttcatcaacttgagcctgagtagagagtcacaaaagctgaattcaacaatcaaattccattattatttagcatgttttataactgtggagaaagattaatggttttaaaagaatcagaaatgccaagtcatgaaaacacagtgtactgtgggaagacataacaaagtggttctaactggcaaagagtttatttagtggaaagaggtaaaaacacgtgggaaagaaagaatatttagaacccaccaaggtaagaaagattaggttgataaaaactaaaatcacacagaaatatgatcattaagtccagactgacataaatcatagacaaatttgagtcacttaatttccataaaatcaatttgatcctcatttttataacattattcttcctttgctgtgtatttatttaatttttaaaatttatttttttttgagacgaggtcttgctttgttgcccagggtggagtgcagtggcatgatctcagctcactgcaacctccacctcctgggttcaagtgagtctcctgcctcagcctcccaagtagtgggaatcacaggtgtgtaacaccatgcctggctaatttttgtatttttagtagagacggggttttgccaagttggccaggctggtctcgaactcctgacctcagatgatccacccaccttggcctcccaaagtactgagattacaggtatgttcctttgctttttaaatcgagtcctgaggtgactcacgcctgtaatcccagcacctcgggaggccaaggtgggcagatcacttgaggtcaggagttcgagaccagcctggccaacatagtgaaaccctgtctctattaaaaatataaaaattagccagatgtggtggtgtgtacctatagtcccagttactcaggaagctgaggcatgagaatcgcctgaacccaggaagcagaggttgcagtgagccccgccaccttactccagcctggccaacagagcatgcctttgtctgaaaaataaataaataaatacataaatcgagtcctgaatctggaataacactaatcttatttatttatttacttatttattcatttattttcagagacaaagtctgtcacccaggatagactgagattatacctccctgcagcctcaaactcctgggctcaagtggtcctcccacctcagcctcagcctcccaagaagctgggactacagacacatgccaccaagtcaggctaatttaaattttttttttttttttttttagagatggggttctcactatgttgtctaggttggtctcaaactcctggcctcaagcaattctcgaacatcagcctgcaaagtgctgggattacaggcataagccatcatgcctaacactaaataaatctaatttcaaatggtataataacttttattttctttttgaaactgacttctgaattttaagatttgcatcatacctgctttatgcctgtcaattccatgcaaaattctgaaagaattggatgttcctgaggttgaacataagcctggaactcagagtcaatctgtccagttgatgtgttcagcaacactgctggaaactcaactaaatgaaagaataatcaattgacagttgaataaataatttttaaattaatcctgtaatcatcctaaattaaacatgttaccattttaattaaacaaccagttttcagtaaaagcatactaaaatgaccaaagcagtgtgacataaaggttataataaagttatgctaaagtcaaaatattgaagttatgagcatgttgtcttaaaagaaaacaatataattaaataaatataaaaaccatatggaatataaaatttactttttttgcaaaggcatttttttcagtttctatgccattgaggtgttgtatgtaatataaaacaactattttatataataacacatttaggtatttgagattttgctcttttttattcaacataagttttgcattaaactaccaatgcatagaccatcctgttttcttaaacttttggctgattcagatctataaactttaaagtgactcatctagtgccagctttggccattcgtagcccagacttacttatttcctggctatggtggtgcttcccatcattccagcatgtcgattcaaaatcaatgacaattaagtagtcaaacaactgctctgcaaaagatcaagttgttcttatgctttaccagtgctgaaaatgcaaggctacaaaatgcaaagaaactaagcatactactcactggatttgcttcttccgagatttccatttgctggcgcaattgactttctcctaattaatccaagctgcctaaaaatgtgaagcaatccaaatatgatcaatgaactcattcacactcctgtttgagtaggctaccaaactaatggtactgggcaacaatctcattatttattgtgactgaggggaaatcgaactggactttggctttacctgcacaggcctcgaaagtacatatttgcaaattaggctaatttgttggttttgtttttgagacagggtcttgctctgtcacgtaggttgcagtgcagtggtatgatcaccactcactacagccttaatctcctgggctcaagcaatcctcccaccacagtctcctgactaagactacagatgcatgccaccacggcccattagttttaatttttttttttttttgaaggcagggcctcactatgttacccaggctcatctcgaactcctgagctccagcaatcctcccacctcagcccctcaaagtgctgggattacaggcctgagccactgtgtccagccaatttacactaattttatgttacccttgttttacagtaatactgagtaactcatttgagttcctacaatcatttgattgtagaggtaaaaatgcactgaaaatcttatttttccccctgcattttttaagctcttgctatgtgtacagtgcagttttaagaagacaagacaatgtaggacatggttcagtcttccagtttaaaaatctgggtaaagaaacaaaagatagggccaggtaaagtggctcatgcctgtaatcccagcactttgggaggccaaggcaggtggattgcttgagctccggagttcgagaccagcctgagcaacatggtgaaaccccgtctctacaaaaattataaaacctagctggggcgtgatggtgcatacctgtagtcccaactactcaggaggctaaggtgggaggattgcttgagcccgggaggtggagactgcagtgagccgagatcatgccactgcactccagcatgggcaacagagcgagaccctgtctcaaaaaaataaataaataaaataaaataagaaaaaaagagaagagcttactgaggtcttaagtgcaagtaaaacaaactacttggtattagcaggtagagttttaactaggcagacacctcctgtagttttctgtgtttgctaagagtgggaagtgccaggatttgggaataataaatatcatttattgactgcttactacatagcaggtactaaaattaaactaagatgatggcctcctttaatcctcaacaagtgtagtagctagaaacttttcctacctatattttatggatgagaaaactgattcttaatttgccaaagaacatagctttggtatgtgaacccaagactgtccaattctgaagctcatgctatttgctattatattacatctttctagtaatcagaaatatgcacagcgcatccaggaatcagggaggacacaataattcatattgtgaattaaaaggatcactaggccaggcaccgtggctcacacctgtaaccccagcactttgggaggttgaggcgggtggatcacctgaggtcgggagttcgagaacagtctgaccaacatagagaaaccccatttctactaaaaatacaaaattagctgggtgtggtggtgcatgcctgtaatcccagctacttgggaggctgaggcaggagaatgacttgaacccgggaggcagaggttatggtaagccgagatcgcaccactgcactctagcctaggcaacaaaactccgtctcaaaaaaaaaaaaaaagatcactagaaaatgggtttgtaaaaagtagaggttcctcttcaaagacttccttccccgtctaattaggaataaatagtaacttctcttagagcaaaatttattcaaagacctgtgctaacattcttaaatatctgctagatataataaagaaatcaatgtactttatgttcttagctcccacaatttagcctaaatatttgccctggcatgcttatactggtccaatcaaacattaggtcatagcctgttcctcttccttacttaaaagtgtttttacctttctcagcattccacaagttacttccttcttcctttgttctcctctgcctttgcctcttttaaaaagttctatgttgctagtcagtcgggacaaatacagaatgtgaggtcccgttccagccaaaggaaaccggacacagcagtagggtggacgcgccacgttataaatgaccctgtctcctttgttcagtgtactctcctggcaaaactgctggcgagtgtaccctttctgcaggaagtaaaaatggccttactaaataaattaaatttaagtttaagttctatttctttacagcaccgaggaacgagcatttcgaacaggttgaacaccttgacagattcagtgtgtggcctgcctgagacctccaaccagtctgcagggcactgtcacgtccagtcgtttcccaaggcctaaaataggcaggcactggctcaaggccacacagtcaaggccccagggttcgtccgcctcgggctcctgtcaccctcgggtagaaggtggcccaaggctgaagaccgaggtccagggaggcgcctttccaaccgtgccagagagggcaggtcgcagacgccggggctgcggggaatagaggccctcaccgcagatgccacctgccgtgccctgctctgcggccaacgccagcgctggacccggagctacccgcccccgacccggaactccctcgagtaccgcgcgagccgcttggtcgccattcccgacactccttgcttttccaagtccagctgccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccggtaaccgatgcggacggtaaagccgtttgggttagagcggcgcgggtgtccagtccgcggaacggggagatcgttggcaccttcgcttttttaggggaacggggatagttcggtaaactgaattgagaagcggatccgagggaggttgaaagctgtcaagcccgtgtagctctcccgctaggaggcggcacgcgggggaataggggcgctggagtttccccagctctacctcatctttctccacagccatggagccagagagggaagggaccgagagacaccccaggaaggtcagggaaagcaggcaggccccaaataagctggtcggggcagctgaggcgatgaaagccggttgggatctcgaggagagtcagcccgaggccaaggtgagcaacggggatcccgagcaggcggccctaggcggtttggagctcccggaccctcgcccaacc

SEQ ID NO: 1021 - DNA, 29123 bp, Homo sapiens
cctgggcagcttataaagaaaagtttatttggcttgcggttctgcaggctgtacaagaagcagggcactggcgttcgcttggcttctggtgagggctttcatgctgcgtcaaaatatggaagagaaggtctaagcggaagtgggcaagtgtgaaaggaaaccaaagccaggggatgagggatgtctgtccgagctttacagcaacccactctggagggaactaatccattcccaagagaacaaatgccattgctacagagtgagaactcattcagtatggttagatggcatccagacattcagagggttctggctccctgatccaaacaccccccactgggccctacctcccaccacagccatgctgggggattaaattttaacatgagatttggtgtggacaaacaaaccatatccaaacctcagcggcaaatgacccatgctctacctcttgctaactgccctacctaaaccaagcagttcaacctccctttgcctctttccttatctataagatagaaattataataatgaagcttttttaggattaagtgagttgatttatataaaacacattgtaaatttcaaagaatgttgattatcagctgggcatggtgactcacacgtgtaatcccagcactctgggaggccgaggctggtagatcacttgaggtcaggattcaagaccagactggccaacatggtgaaaccccatctctactaaaaatagaaaaatgagctgggcatggtggtgcatgcttgtaagcccagctactcccaggagagtcactggaaccctggaggcagaggttgcagtgagccgagatcgtatcactgcactccagcctgggtgacacagtgagactccatctcaattaaaaaaaaaaaaaagaatgttgattaccatcattactatctgagattcaacttttcttatgtcaataaatacagtatacctctttgctggctacattcagagttatgtaacattcatatataaatctttgtgaaaccttcagattatttagcatagattcctaggagtagaaatatctatatccaataatttgagttttttgagggttacttattaaataaaagtcatatctcacaggcatagttttaggagtttggggaatggtgagcaaaacagacccagagctagaagaggatatggtttctatgaaaagtgacaatggagaatgtacagagtactttgagagtgcaatctagcctgggggggatttaagataaagtgacattgactttaagatctaaagaatgattagggattaattaaatggccatttggaagcaggaggtgaaatcaatggccagcaagaaagtcttgaaacaagtttgggagaaacctcaaaggaagccagaagggaggaagagagcttctggatgaagaggaacagttgggcaagatcctacaagtctggtaatctgtctgcagattttggctttatcctctacatagtcagagaagggtttgaacaaaagaatgacatccattcttagggtgatgcttacactaaaagcccagacttcaccactatgcaatatatccatgaagcaaaactgcactagtaccccttatatttatattttttaaaaaaatgacattcgtttgtattaccaaaaatgaaacaaagaacactctggttgtatgtattggaaggagcactgtaaaggaatgtggccttccccttaagaggcctagtggtgggagagatggcagctgggactagggtgatggtgatgaggaggcagaggcatggagatggtgaaaagactttgatgcagtagcagaacctgcctatgggccacatgtagaataggagtggggagaagtaacttctagctctctgcttctgcagcatactgagaagagaagtgtagaggaagcagatctgttaagctggaactacaggttgaatttaactttaaatgtatgaactttgaggttgaaaattatgattgcaacttcaagaaagagtgttgtgatttacatctgcaccagcaggatttgagggggctttcacacaatcataccaatttttgatattattgtaatttttactaacattatttttaaactttgcctatttggaacctgaattttaatcttgtttaaaaacatgcactctgatttctagtagtctgagcatttttttctgaactttaggtacatgtagatttttttcaattgtctgttcaggtcctttgacaatgtcttgagtacttatttttatctatttgtatgaattttttctacataacagatcacaaccccataccttttgtatttaatgaaatacttttttcttattttttaaagaattctcttgaaacatggaggtatagagcttttaagccaatcaaatcattccatgtatctgtgtgtgtgtgtattgtgtatatatgtgtgtgtttgtgtcttggttgtgtaatcacattcattgtttctgtgttcacatatactctcccatccagggagcagacaaatatatccttatatttactaatacttcttaaggtttttgtgatggtggactttctgtgtcaacttgactgggccctggagtatctggatatttggttaaacatttttctggctgtttctgtcagggtgcatttgcatgagaataacttttgaattggtagactgagtaaagcgggttggcttccccagtatggatgggtctcatctgatttgttgaggatctgaatagaacacaaaaactgagtaagggagaattttctctctctgcccaattgcctttgagctgggacatggatcttcttccagtatcagacctagacagaaccataccatcagctcttcttctttttgttttttaagagattgcttcttgtgaataccattcacagatgccaaccatcagatatagatgtttgattagcctagtcttctgggactccagctcactgactacagttcttgtaatttctcagcctccttaatcgtgtgattaaggatggatagatagagagatctagatagatctagatagatagatagatagatagatagagatttactacaagatttatttattgtaagacagatatattcccacccaaacagaaacaaacaaacaaaaaacccagaagaactatacaaatctttggagtcatctagcatagtttttttcttttcctttcatatcacattcatctgcaagtctcattgtcttgagctgtagaatttgacctcttttataacttctacagctatatagatagagagacatagataaatctatatagttaggtagatagatagatatctatataaattgatagttatagagatagatatcgtattggttctgtttctttggagaaccttgactactacagttttcatttaaatgctttaactatgtatctagaatttaagctgatgaatagtccaaaagaagcctcagaatttacttatttttcccaaatatttttcagggctatgttttgaatggtccttttctgctcacagatttatgtttctaactattatctagtaataatttgtggttaaagttactaagatttgtttctgggctatttttttcatccaacgttatgtttatcaataattctacaactaccattttgttttctaattgcaagtttagggtgaatttacaaatcaagtcaaacaagtctcttgtattataccatgtttttcagttatgtttctctctgtttttcattatcaaatttatttcttcagatgaacttcagaatcatgttatcaagttccaaaaatttgagtcattagccaacacttgaaatttcattaaatctactcattattttaggacaaaataaacaggttatgatttggagtcaatctcaaagaaatttgtacgtcttttgctttatttgagtcttcgttttatgtttttgtaaagattggctttttttttcttacatatttgatctgtccttagctagagagagatgttaaaaataaatagaacagtgctttcctattgattatcctttgtaattttttttaaaagttttaaatttatagatagttgttttattatccaggacacatattttattgtgacttgtacttttaattcacaaaactattattctttattttattttttgtgtttccatcttaaaaataatttggctgaaatcaattctgttcctattttctctgtgtttgcctaataaatctttgcacttctttgacaaaaatgtcattttgatttagatagtttccttttacttatcatgtccttggattttatttttaagcacatcctgaagatatttgtcttttaatagaagagtttaaacaatgtgtttccataataatgtaattggaactccgtcatcttattttgtgtttttactttgctttccattctttactttatgggtttcatgtgagttctctttccatgaaaagacttttgtgtgtgtttgttttcaagaaatatcattcatctatagttatctaattaccaaactcaagaataaaattatattctttgttaactcccaatataatttgagcaaattcttttataattttgtaaatatgacatatggttttgtactggaattatttttattaaaatatctcacattatatatcctcttttttaacaactatctttacatttccagatcattttgaaaccatattctctgcagtttatattttgctataggtgtaactggtttcaataatactagaaatcttgtattttaatttctgttgatctctaggtagaacacagcacacatataagttgcacaaaatatctccccacccaaaacaaaaacaaaaacaaaaaaacagaagaacaatacagatctctggagtcatccatgatggttttttcttttcccttcacatctacaaatctgcacatctcattgtcttgagctgtagaagttgacctcttttatttcttctatagctatcaccctagctcagcccaccattgctgtttattgcaattatggcaatggtcttctattgggtcctcttctacaatggcttccaattaaaatgttaggtaagcatgtctctcctgtgctcagttcctttcgctccccatcttactctgagcaaaatgcaaacatactgcctactttagtggaacatgctctctgccctccaccaacctcctatcctcattgctccagccacattggcctcttgctgtcctctccattgctccagccacattggcttcttgctgtcctctccaagaagtgaagcatacttccacctgtagtggccacccctctattataatatccctctgagagctatccccttccatctctctggtttccacccacatatctccttatttaagaaaactttctgtattattcttcataaagtttcactcctcacctccttcacaccccaataagtaattgttttgtacttctcttaagagcagcagaacataagacaatagtaatcctaaataaaaagaaactaccctagctaacaaaacatgctaaatttcaaaaaaaaaaaactgtacttttagaaacctacccttacataaaggcaatatggctgctagaaggggctgtaaagaaaaattcaggtttctgaattatggagacaagaacacattgaacaaaggccatataaagaatttccaagactgtttgtgaccagatggagacaagtggggtgagtgggcattgcgtatggttctgaattcctctgtgacttgctgtgttcatgagttactatattttatgttctgctgttcctatgagaaagcataatttactttgttgagaaaacacgtagatgaaccaaaacatcttccatctttaatgacatcactcactttctgccaatgtcatatgagttcacccatgtcacagaaatatgtgcatggcagaacagactacatttccctactatgatatctttgcttaatttccttgatagtcccagcacacgcaatcttaatattaataagtatttttttcttttgggaaatcaatgaggttagaaaattatggctgctgtatattgttcctctttcgttaatatctgtagtggactcttctagaagacaaatgaaacaaagagctgggaactatttttgccaatcgtagatgaaatctctgatccgaaaattgtgcttggatttttttttctttttttctaagatggtgaactggatgcattgttagcatgcctctcccacttgaaaagacaaaatactgtgtagaaattcatgctgtgaacgtttttccaagaaacagcataggaaattaatcaaaaaactgaaagaaaccacagacctatttcaaagaagtggtgagcagcagcttacgccgtgaaccacacaaaaacctgtgagtgtccagagcgtgagagggagagactgcatttatgacacacactctcactgaggagccaggcaatccaggccacgctgggaggccttcactctatccagcgctggagctgacttactgctgtggggagcatatgaggaatggcgtgcggatctgctttgtgttcactcgcagaatccagtggtgatggaaggaaatcatgcctgatcctacctcacggaggacctcgcagaagtctgccagctaattgagttaatggtcatgggatgagagatgctcccaacagatgtgcggtataattttgagtgggaatgaaccccattggccagaattgagagtcaagtgggaactgtgctatagccacaggcacagaagctggatgcccacgctttgctggaggaccagaagaggtgtggcctgaaagccgcagtttctctctcagcccagaatgcttctggcctggggcagtttggaattctgagtgcaggctgtctggaacccagctagctgctgctagtagaacactgtggatgcgagacctgccttgccaagtgtgtgggggctgagtggggcttactgccacctgctacccccgactccccatgtggattcatttgtacagcagaggcagctatactcctccctgtaacattaccccagcaggcagggagttgccctctgatcaccactggggctgctgcttgtactcacaagtggggagccaaacagcaaacttgcctgacccagtccccacctggctttgccccttcatctgccctggtagtgtgatacaatggacagagactcctgggagctccatggccctgcacattgcctgaaataccagagtacgccactcccttccccccgactcccctacccatggtaacataaggcaagcacgaatcccaaaactaccaacacagttggcattcttttgcaagtgccacctcctggctggaggccaagtggcacagcccattacaacatctgcaggtacaataacacagtgcccaggaaggagaaaacttgcacaacctcaactatcaccattgcctacatcaccctggctagccagtagatcttgagtctgtccatgtgcccagtacatgaccaccacagccgtatttgagaaggccaacacactaaggctatttataaccacggaaatctcacagggtctacgtcactcccttcccacccacaactgagctggtactgatatccactgctgggggaccagacagatcacatcactggatcccttgcaaacattcaccagcaccagcatggagtatggaaacctcactggggatgagacccagaggagcagcagtattcacggtagtctggccctcagggaccgctactcttaggggtgtgggagtgcatcacattaaaggagcatcgtatgggacaaaggaaaccagactgcaggccttgagtccctgatctttccactgtggaaagtttctttcagcagaggcacagctcatcatttatacctgtaacaggagagagcacaaaatctctccttctttcaagcaagcggttaatcaatcttctaaaaccaggatgtgtgttttgagctaatctctgccagcagagtatcttaaactactcagcctactgatgaaaaaaaaatttcaccagcagagggctgaaaaacaatgtggcaacaccagaaagttgtctgacattgccttgatctgagaggatgataggaaattttttggctgatttgatctcttagtgtcctgaagtttagtgtcattacttacatcaaatcaatctaagctattaaaaagaaaagaattctggtgaatgaggcaagatctaaaagtgactttttaatcttatgagctatcattttagatttatatatctcattttctcaaatggcatgtatagttaatgagggtcagggcatttctcatgtatatcctccatgtcacttactgtggggatttgtactgcactaatgtagacaaataatttattgtgagaggttgttgttgcaagtggcaagttaggccactgaattgaatgattaaattctgcgtttaaatgagttctggaggagcaagactagttcccacaatgtgagaagatgactttaactttcagtcctttagtctagtaggtaggaaaaaaaaataaccagaaattaatttgattctctgcacctgtacacctgactgctgagaatgatatgttcaattgctcaggggaagaacactttgaataactgagagtaagttagaaattatcacctatacataaaaactagcatgctatattgtaatacctgtgatatggtttggctgtgtccccaccaaatctcatcttgaattgtagttcccataattcctgtgtgttgtgggatgcagtgggaggtaaatgcatcatgggggcgggtcttttctgtgctgttgttgtgatagtggataagtctcatcagatctgatggctttataaagaggagttcccctgcacaggctctctctctttgccagccgcatccacgcaagacatgacttgctccatcttgccttccgccatgactgtgaggcctccctagccatgtggaactgtgagtccactaaacctcttttttttcccagtcttgggtgtgtctttatcaaactgcaacagaagagggcacaaactcctcctttcaaggaaaagaagaaaaacgtagagttcaaaatgtctgtggttaaccacataatctgagtcttctagtaaatactatttcctgggagaagtgtagttactttggaaggaatctgaacttttagttattgatatgccacttagtatttaaaagacagtgatttacaaaaagactatgcagaaaggcctgggctttccaagttttctccaaaacccctcaggtattcctgatgagcaagtgaagcatttagagggtttaactcaccatgtatgtctaacgttactacatgtaatttatgagtcattgttttctactcaatagctaaatactttcacgtatttttacttatgggatataattgaggaagagatacaaattcaaaaagcatccagaactgaaagctctttccatttaatttatggtatataccagggttggcaaactgaatctgcagaacaaatctgacccattatttgtttttgcaagtagtttttttagaacacagccatgtccattcacttactcattctttatggctagttttgtgctacaacagcacagttgagcagttgtgacatagatggtattgacaggatagttattgacaggattgacaaagttgcaaatatttaccatttggctttttacaaaagaagtttgccaaccactgatgtatattattagatacattagtaacaaatgacatcataaatttctttctttttagcaatcatgtataccaaggatataagaaatacatctcattagaaaaaaatcttctattcagccgtcttgcttcaccttcctctagaacaaaatcttattgccaaataatttaagaaaataattcggtcttcagattcaatatttgtgcctcaggtttccttcctaggaatgaattcccacttcaaaaaacagacacacacattccaaaagtgttcttttatttctagtaacatatattgtataaatactctattttatatgcacttccacaaaagcgatataatttaaaagtttttttcattagaaataaatgtataaaaataaatatgttattataggcatttattactaactatagtccttcttggaaggaacacccaaaccaatacttataaagtacatgtaatttatagtaacatattttactatatacatatggaaaaaatcatattctcacagaagagctgaacagacattcaccaggatacgactgttggaccagctgctggagatggacctgctacccctcagcagcctccccaccacaagacaagtgatctcaatgtccccaaacctgtgggaccctgttctacacacctcatttttgttccggcgtttcatcctccttgtgtgattgtactgattttcatgagacacaagttacttctttacatccatattcccaaagcagggttacatggtaggaaagaaaggaagttggaggtactaagctcattgtgtctcctctagcttttaccagcatctaatgcttcactgctttttttccattgtagactttaatgcacttgaataaatacatggagttgttttttcctcaaaatgaattacacaaataaagactgagatggtccaaaaaaggaaagaggaagccatttgcgttatttcacgttgctgagcctttctctcatgttgaacaatctgaagttttaattctcggtagaaataatgtataaacattctctgaaaccatagcagccataaacagtgctggtcaaagatcctatttgtactcctttctccccccattgttagtgaggtaaagtaaaacaggtcttagtaaaatctcacttttctcctacttttcatttcccaacccccatgatactaagtatttgataagtaccaggaaacaggggttgtaatagttctaactttttttgacaattgctttgttttttctaaacttgtaatagatgtaacaaaagaaataataataataatgcccggggctttattatgctatatcactgctcagaggttaataatcctcactaactatcctatcaaatttgcaactggcagtttactctgatgattcaactccttttctatctacccccataatcccaccttactgatacacctcactggttactggcaagatacgctggatccctccagccttcttgctttccctgcaccagcccttcctcactttgccttgccctcaaagctaacaccacttaaaccacttaactgcattctgccattgtgcaaaagtctatgaaatgtttaggtttctttaaaggatcacagctctcatgagataacacccctccatcatgggacagacacttcaagcttctttttttgtaacccttcccacaggtcttagaacatgatgaccactcccccagctgccactgggggcagggatggtctgcacaaggtctggtgctggctggcttcacttcctttgcacactcggaagcaggctgtccattaatgtctcggcattctaccagtcttctctgccaacccaattcacatgacttagaacattcgccccactcttcaatgacccatgctgaaaaagtggggatagcattgaaagattccttcttcttctttacgaagtaggtgtatttaattttaggtcgaagggcattgcccacagtaagaacctggatggtcaagggctctttgagagggctaaagctgcgaattctttccaatgccgcagaggagccgctgtacctcaagacaacacctttgtacataatgtcttgctctaaggtggacaaagtgtagtcaccattaagaatatatgtgccatcagcagctttgatggcaagaaagctgccattgttcctggatcccctctggttccgctgtttcacttcgatgttggtggctccagttggaattgtgatgatatcatgatatccaggtctgcaggtgacaaaaacaggcataaatctctgattcattggctaattagattatttagcttaaaaacacattaatcttttatgagacatatttttttcccagacctgttgaaaggcccatttaaattataaggtctgcaaataggtgttttaaaacttactttgcactagtaactgatcctgatatttttttacaagtagatccatttcccccgcaaacaccacatttatcaaacttctttttggagtctatgatgcgatcacaaccagcttttacacactgtccttgcacacagacagaggtggaatctgggctacatggagtaccatctacaacctgaaaaaaggacacatgtctagtgttacatacaagcaaaggaaggagatgctgcaatgataagtgtaaacattttctctctactttcctgaccatgctaattaaacacagtaccctctacacattatgcatttcatgcatttacccttcactttggcatatttttcagtactacgtatagacatctgaagaaattagatatttttaaaaattatttatctattgacctatgtctcctccagctaaggtcaatgaaagtagagctgtttgtcactttgtttactgctgtatcttcagagcctagaataattagtatctggcaagagtaagtgcttcagaaatcacttgctgaatattgaatctgcaacttgggaatattttcatagcctatggtgctaatgacacacgatcatctcaatcacattaaattccattttctgtctcagatccagatgtattcccttagcaaaacagcaaaagaaatgatgcttttcctagttcaatatgtgttttcaaacataaaaataatcaatactcagactaccacttctattattctgtttgcacctgctactgctagttacccagtaacaagtattttggaccatgcatagactattttccaaaactactggttactgtgtgaatataaaatgtatctaactatgagctgtatgtgaagcctagtcgcacagaggagcgcttgactgtccaaaaagcttttctttgcatataaaagagtaatagcgagcaattgcaagcatgtgaagtgttagatttaagcttcattcataactgaaaacactaaactcaaagcaggcagttgccaattaatgtaaaagaaaaggagttcaaatttgaaattgaagatatgttaatatggaaagcaaagaaagtataacaaaaattgtttgaaaaggtagcaagcccaggccttgatttttaggtaaaaataaggtaaaaacgaactaccttgggctgcaaaacgaagaagtagccaatgcctttggcttggcagatgagcttgcacctgtcctttggtgagacgccagcgtacttgggaatccattccaccgcaggcccactcccaaaggaagcttttgaaaactcgttgtgtgcttcacattgttcctctctaaaggtttttcctggaaagagaataatatgataacattatcagtttccaatcttgagccacctgtttgtgggtacatctttttttaatccagtttcttaaaaccagagtccgttgctcctcaccattattgtctggacagtcctcaaggttacaggatctgtagcgcactcgtttgccttcacagtacttccctccattctttgggactgggttgtcacattccctcatcgtgtactggactcctccaccgcacgttctcgaacagtctccccaaggcccccacattccccagcttccatgaaaaggcgtctaaatggagacataaatcatcagcattagaattatctaaagagaacttttagggtatcaaagaaagccacatgggacaaagaatcagttctaaaaataagctatctcgcattcctgctagaggacacggatggggatgtttaacttggtatcatatcttttaccatcactttgttcttttcaattctgaatgtgtttcagtagaaaaactcacatcaaaatgctttctgtcggttttgttcacacacttgccgttgatacaccatttcccttctccacagctggtgccatccgcccacgggaagtgtttggtttgacacaccagcaccccaccagaggtgccggtacaccacaaggtgctacatgtgctggctgcatcggggcagtgtttggagtcctccccaaatgtaaactggcactgccggttggcatcgtacgaggtgccagggagatcgcctgggagctgtatgggattctgaggcttgtccatcaaacattcccctgcaaaggaaatgccaaccaatatcaatacagagttagtgagggcatgaaggggtagatcccatttcagaaaatatttatcatatgagaaaatagacagcaaagtgatctgaaaactgtaaagctgggggagggaaatgctgaagagatttagattactattaagatcttatcctcaatggggtatttctatattaacaatgacaggaagttattgatctgcgaacaatgtgaatgaatgggctttgggagctactcaaccggaagcactattttttatttggaattaagatctcaacagttaggatcttgacagaggaaaagtaattttgaagtggggaaaataaaaagaacaaaaaggaaagagttcatttaactaaactttatgcgtgaaaggttggatgccatctagagagagtagctggaatatctcaccatgaccattatccagaaatgatgtaatcatgtaggcactgcaaggagaccaaggctggctgtggtccaggttggaaagcattgacgccatcatgtgggaatcctggttcacaccattaaggctggcacactgctttgcatcatcatgtggcatgttaaacacgtggcctaggaagcaatccagaacccacattaaagtatggatcatggctgggtgcggtggctcacacctgtaattccagaagccgaggcgggtggatcacttgaggtcaggagttcaagaccagcatggccaacatagtgaaaccccgtctctactaaaaatacaaaaattagccgggtgtggtggcatgcacctgtaatcccagctactgggcatgctgaggcagcagaatcgcttgaacccaggaggcagaagttgcagtgagccgagattgtgccactccactccagcctgggagacagagtgagactccatctcaaaaaaaataataataaaataaaatatggatgatatgcagcaggttcttttttcccaacagggattcattcatttgtcccaaaataacatttctagagaaagaaatatatttaggagattggctcttttgcagaccatgtctacttttcacagggtgtaaacaaacatacacatttccaaatgtccagagctactactatcttattttttactttaataaaaatgaccatgtttgaaatagtgacaaaatattttctatagtttctaagatgcactaggacctaaaatagcaatataacctacagactctccttcttatattgttttaccagtttacatttctgaattgagcttaacttctactttgaagcagacttacctaattcatgggctgtggtgaaggcagcttgtaaaccatcatcttctatgacggagcagcttctgctcggatcacacacagttccaacatcagccatcccaagagtatcacatgtctgggacccacacaagtcctacaaaaagcaaaggtaaatacttattaataaggggagcatgacccttgggatctaacttttttggcagggtgtgccttcacatatgctttggagcatctacattcattattgttgacataagaagacttcatgtgactttaatcaagcttttttctaatgcttttaaaatagaactgtgaaacttgagatatttaaattacagtagaaatgagtaagataaaccatgctagccaattaaaaaaggttaactgcaaaaacactggtgaaatgccttgtatatatctttttggtacaacgtagactcctaagaggacagtctcacagctggtaccatcttcctcttacctgtctggtgaaaagaattgctgtgtcatagtgctctgcatcccggtcactgggtgggttgtgctgcttctgccagttgcaaaagttccgcagagtgagggcagcattggaggtcacttccggccccttctgttcatcgtggatgaccaagatcttcaccaccaccaggctaactgaattacgaatgctggggtgtttgtacaatctggctgccaccgaaaacaacgtgagaaggtaatgctttagaccactgccgtggaattctgccatcgactggtctgccacaagcatggtttccacatagcggtgactggacacaaatcgcttctttcttatgcttccagttcctgtaaagaaaaaaaaaagtttgcttatggtcaggctgtccaagaatagttaccttcctagcatatattaggaaagcctaaccagtcaaagcaaacaaagcaaaaatatacccagaacaacaataacaaaaatatttgcatatcttcactccaagtgttatttttaaagttctctcctctcctttaaataaaaagaccacgcgctcctttgcatggtcaggatctttctgtgtgtgagcaggatttcttctgttctctttgaaatcccacagtctgaacaaggcaatttcgcacataatcctacccaattgtagtaaaatcttggagcaagagcggcaggcagaggccctgagtcactctttcacaggcgagggctcaaatcctgaatgagatcatcaggctccacgtggaaggcctcgggtagggcctgggctgctgccaaggggccgggccttaaggaatctcagactgcacagctctgctgtctcattccaggggtccctggggtgctccgctcttgccaattccgggcacaaggaccacccactctgcccagcagcctctggccccactcccactgccccagcgaaataagttccagcttccaggcatgattgattatttggaacagagccttccactccggactgagacccaacccctgcagaaagtcctaaactgggctgcgaccactttgctcccaggagcagaggagcaggggaaaaggggagaattctttaaaaaatgacacgcgagagagttaaagaaggaaaaaggcaccaaagtgatgaaacaaaaagaactggagaataagcactgcacagagagaaggccgtagcaggaaggaccggcagtgactttcaacagtgcttgagagcagaattatggccgcgagagggagtgcaaactgggaggcggggcaaacccgggaaagacctcccaagcaggttctgcgaaggggccccaccgccttcagcccgcctgggtcagccttataagggggaaaggggacagaagtctgcagaacagagatcctagcgtagccgctcagggtaccttcccaggtcaccattgctcctctgccctctccacatccgccctcccgtgagcgcaggatgcacgcacaggcagcggttacaaaactcagcgcaacgttgcaacccgcacaaaaggcgcacacaaaatcattaaaaagaaatacacagagtggaaagaactcgcacaagctccaactcgctaaaggtggaaggagtcaggttacaaactctccctccccggcctaaatgctttgctttagtttgcagaaaatcgtttgtcagtttttttcttggttattcattattcgggcaaatgcaagtatgttttctagctgagttcaccaatccaaacctcaaaccacattcctccactccaggcctccgttctgtccgcggacttatgatcctgcctgccagcaggagtctaccctgaagtcgcgtgggatagataaagtgaggagaggaggatgaatggacagacaaacgagagcaattcttctacctgtgggctgtcctacgccttgcagtgccgggtcctgcggcgaccactgagccccttcgtcctcgccctcagtcccttcgtcctcgtcttcggtctccgctttcccagtcggccggggctcgtcgtccacgaccccgcacgtgccgccgacgtcgccctgccgattccgccgcaggaggtggaactgtagtggtgccggcggcttctcccctggggcggcggtggcgaggcgctcgctggcggcgggcagcggctggatgaaatacgcctcccccagcaggtagaaggcgccgcgcacgccctcgcagaggctgagggcggcagccgagctgggatcgccattcacggtgccggagtagaagcagtgcgccaggtcggtttccggaagcggcgtctcggacccggatttgcgccccacgttctggagcgtgaagccgggcgccaaaaagctgctgtcgggccgcagctccagatccagctgctggtcaaaggcgtgcaggcggaggcgcgtggtcccgtgtcccggggcgcgctccagctccggcaccactagctcctcgtcctcctcggaggggcgcccgagtgcgtccgacacggccagtagcgccgcggcgagcagcagcagcgtgggtactggcccaaagctccgagaccccggagcccgctccgcgttccccatgtcgctgcccagcttgcgccttccgaacccctcgggcacagctcgctgcattggagccccaggagacaccgctcgtagcagcgcacggagcgagggacctttagttcgggtcgggagagcaaagcctcgttggcctgctctggattgttaaaattaacaatttctattattcgttggaagggcgcgcagagccggctacagccgaagctcccggagtcactaaaaggaggcgctgcagttctgccggcgcgcgggaagtttttcttccagcgcaaagttggagacactgagaggcaggcgcaggcagagtggctctgctgggacaagaagcgctctggggcgcctccggggctgaggcaacgcggagattggtgcctggcgcccctcttcggcctccgccttggctgcgatgttgctcactctgctcagggctctcccctctccgtccggtagcgcaccctggctttgcaatagcccctggctcggagccgctttccagcgagtgcaagaaccgggcagccgagcggtccttttatagtggaccagtgaaacccccacccccaccccactcctcccctttggcccttttccatcccaaagacgccgcccccggctccgttggtgctaaaccgcgctccgcgctgcgggctcgggagggggagggggcagcctccgcgctggctccacgccactgctcgtcaatctaggggcggaaggggcgctgtgaccagcactttgtactgctggggccgctccagggagaagactctcccttccaccgcttttctccctcgccggtttcctggaccacccttcctccccaccgcccggttgcggtaactcagttaccgcgctgggctgcggttcccaggagggagggttcggttggagaacgcagtcccttcttcaacatttccctatcctggagctgccctgggtctccttccctcctccctcagttccctcttccccaatctaggagatgagctagggctacactttctagaaaaatacctcaccccacttctccaccttcccagcctgccaggagctccttagccgccgcctgctctctcttcgccccagcttttctagggaaagcttggccctgcgcttcccccagaaagcatgcctgggtgaggggccaggtgacacttcctacgatctggattttaaaatatgtttgcttatgccttcaccctccaccaacccccaccccgcacgccacctcttcaccagagacgactttgtgagggcccggtttcacatttctggaatgggtgatctgggacgcggctcaattccctagagcataaggagggaattgcgctttttcttcttcattcgagaaatgatcggctcccgccagtctgcgtgctttcactcaacagcagctgcaagccctaggccagcgtcgcagaaacggccaggaaccccactttcctacccgggggccagcagcgatcgctggggctagcaagcgtgcagagggggaaagaaggaaatcggcttccttcccggacccctccttcctcttcctaccaggaagggaaaaggctatatccgcgttacgaaagcgaggagaggtccaccaacaggtccttaggaaaaaaaactgagtggctcttctctccaaaaagtgggaggggctcaaggacccagaggaaggacgtgtttcacaggcggaaagccgcggggacaatggcgagagcgaccgccctagccccgggcggacccgcaaccctcacactcgcgcgcccccgcgttagtgctcgaactggtctccgcctttccgccccactcccgtccggtctcttggttggctccaagtagatctgggtcctttcctcgctcctccccagatcttccccacttcagttggccccagccagaagcgtcccttctagttctcccacacgtccctcttacaagctttcttttccggatgctttccaacttcttttttcctagcgagattgcttacttgaaaaacaaaaacaaaaacattgctttccactcatcaggaaaaatcaaatgagcaagaatggcagagagaagcaactcagcttacttctgaagggcttagtaacgacctctagtccctacacatttaggagtgggtggtttcgtagatttaattttggtttcctaaaatcaccctcatcgttgaacgttgaataatcaaccaaggccttagatatattttgacagcgctcgattaacattctgatagtgtttctgcctacctcttttcactgagtctctcctttgcagccctcgctgtctctccccccctcccgccgttgcatttctccttcaaactcaacattgacatccgcacacctgagtgtgtgattcctttctgcattgtcaagcattgtccagcctacctccttctcttcgacttcgaactacgaggattattccttcctgtttctctgtttcccaagcgtcttttcccaaacatctgatcattcctacttcccagtttggttttcagacttttttttttaacattgttatcttctattacagtaattttttgacggtccattttctatgatttcatttcattttactggttctttctagctagaaaaaaggcaagatacttgagagaacatatgaggaaagtcatgttagactttcaagatattgaccgcgggatcacaaaagcttgaaggcaaagccatccgtacattttcaacctcttgcttagaaaagggctcagaagataatatatggtgacaacagttacagcctcagagtggctttgagatggagatttgagatggagattttggacactcataatctccatctcaaggagaggtggcccagaggctgaatgaagatgagtgaaggtagatgtgattcccttaaattggggcaaaaagggacaaaaacagcagaaaatctgtatctttaaagacatatgtaatgtatttcagtctatcaacttctctacataaactttagcttttaaaaatatgttaacgtaagtttgacctttagtgtgtttctacctgcagggtattcttattggaggtttgtttaaaagcatacatttctgatcttgaatgggttactacaaatccattataattgtttcatatttcatgttgcagatacaagtagggttgaaaaaacagtgagttaaaggcaaaaggatggccgggaacatggcttttttattctctgggtttctatccagatttctgttcttttgcataatgactccaatctgttgtgcacctgtagttctgggaaatgattcttttttaatcgcttcaacagagacatggatgttggagttgccaactactaagctgaaaaactccatctatgctcagaagaacatttaatccacttactttttctcttttatttaaagattagcactcatcaggcatttgtggtaatatgcaaatatatacataggacatatatgtatatttataagcaaaatgtgaattggaaaaacatttgaatgtagaaacaagaccacaggagtaaatttgtacaaggcactagtaaaagtgacatgtaatatggggttcttgtagtgagtttcataatccaatttttgctccttgatttgaatgggcacccaaaataacacatgctatcctaatccctactccccatattttgggttttatttttatagaatacatatgggcttatataaacattaatctcaacatgttctaatttacatatgtaagctaatttttatttctagagataacagaacaaaactcaaaacatttgacataaaattattggaacaattaacagtttgacctattaaacacattattgtcctctatgaacagagggactgtctgaaaaaaagaacaagttgtctgcattttaaagtgagagataagcatcaaggtgtcaatttctatttacaccttatgtgttcttatttgtttcacagattcatatgttatagacacaatattctattcacaattttcacgacgtctataccaaagtaagtattcaacaagtagccatgaaatgaggaaatctggtaatatacatgagctattagaattgttttaatgtaaacattgtctagagaaacaactaatgtgcatatttcataaccgggaaatgctttttattcacattttagtaccataagattgactaattagaaatagggaagctgtttggtattagtcctacttttgggaacatatggtctaaagtaatattggacaaatggatattttaattgatcacaaatgagaaagtagttagaaaacttctagtttaaacaggttatatacccagaagtattgcaaatattggagacagaaaaattattgtagcttgcatttagactcaaaattgatattccctccacatcatgccctcacagaactcagaggagtatgatctgccagatcgactccctttgtgtaactgatgcagaaatgagactcaaaagggttaagtagttttcccaagatgtcatagcgagagtcaaactgggggcttagaaatgactctgactcataacttttaatcaactgttttgacattttaacctatctaattgtgtaggaggtaattatattgtcagactttggaatgatgttgtttccagtaaagttttgttttaattataaataggaattttccagcaataaaaaatttccaccttaaaagattctcagactttagtacatctttctccaaacacaaggtggcgatggtctacaacaaatgatgtgcgacttggtgttttttttttttttttctttcctttccttttttattcttaatagttcaagttaagaatttgcaaaagtttcacatcttctcaatcatgtttaataaattctaattaaatattctcctacctcctagtattatggaaaatattttaaaaatattacaatgttaaatgaatttattcttgagggcataataaaatgcgtttttaaatcaactactttttaattatgtgtttgtattaccataaacaaaaatccaattaaactttaaagaaagaaaactgcctctgacaaaataatactgtggaccgcttttattcattacatttgagaacttcttgtcattcaaatgaaaagattaagtacatttgcaatccactaaaacagattaaaaactcattcatttattcaatagatattaagtacatacagtatgtttagtatacattaatacttgacaatcaatactggttaactggtttccctggtttagaaattttccttagcaacaacgtaaggcttaaaatgaaaaaagaaaagtgagaaaatgttctaccaccaggtggtgacaaaagataaaatttaaaatcgctcttaatgagcacatacttcatgtaattcttgaatactgcaaatataagtgacttccgaatgtcatgtgaatttaaaatcatattctaggaatattttattaattaaagcaaattaatattaacatattatctctagtttaataagtgctggaattggaagtggacagttttagtcagcaggcggcacttgagaccatggaataagatattttaaactatttcactactgctttttttccccacccggcttataattattgattggctgattgagataggagctggtcacctccctacacttccactagcagggatttaatcagaggctgaaaatcaattgtcctttgaaagtgatttttgctaaagatcaagagcaatatttggttatatctcagcctctatcctacaatatttatcattttataatgctcttttgtgtaagatacaataaatcttattaataaccaaaaactgaattatgaattattgcaattcattggccatctacttgggcaattacaatggttagtagctcagaagcactgatatttgagcactgtatcttcagattccgaggcctgggttaggatgcttgctgctggaaacactggctggaaagctttcttgttccatgtggctctcaggtcaccctgagaactggacacactcgtaattggttgatggtaggcttgtatattcatgaaatgttgattggaaaggcctagacaatctctctaaatacataattggacaagattgttgaaaggattagagttggacactattctaaagtggcacaatgtctaagcatagaggctgggggtcttcctgttccctgcacttaataccctgggagctagtggtggagagccacgtaatccacatttgaattctggcattctgactgctgcatccttactttgtggcttcagggaagccatggatcatccctgagcctcagcctcctcatatgtaaaatggagatgacaacaatcctgacttgaaggataatgcaccattgtatttgcttcctcctctgtctcttccttcctagttaccccctcctgtttcctaaacttacttgcccttgcctccccacctctacagggactgcatgcacacaagcccttttctcaggttgtgctttctgggctaaactgagttgaaaacaaagagcatcaggagatcttctagatgggactgctcactgatcagagggcagtagaacccgtttgctggtggtgaatggaatgggaccgcccccggcatgcagtgtcagtgcaatgacaaagagtctctgtgtgggatgaggtggtagtatggggtgagaagcaggtttatgcagcagcagcggcacttagacagtatgaggaaaataacaattgaaaggaacatgtcattggatgggtttttgatagttgcttcagagcaggggctggcaagctatgaccttcaggctgaccatctgttcttgtaaataaagttttactggaacaaagtcacaatcatttgcttatgtatttttcatggttgctttcacaatacaaagcagagttgaataattgcaaaagagagcaatgtccaccagtccaaaatatttgttatctggccccttcaaaaaagtttaccagtgcctgttttgaaggttattttggaaatacagagattatatacagagattacatcgttttctaacttaatttgaagacatgccataaaagtcacttttatctcctgcaatcagagagcagacgatgctgaaaatctaaaaatgtataatcttatagttgttttatattaaagttagggtcctaatagaaaaactatgggattctgatacataaaatgcagacatttggatggatgagccccagattctcctagaccctgcagaggcagatgtcacccccttgctagaagagaacacccttttttggcctacagactgtaaagttctcagcagaggcaggtgcctcagaaggatacttgtcctgctcatcttctgccccatttccccctcattcctagcctcttaaagtctaaaatttcttcgggaacttttgttaagaaacactgaccatatgtattagtcaagattcttcagagagatagaacatatgtatttaatgagattatgaggaattggctcagacgattataaggctgagaagtcccaagacctcctgtcaccatgctggagactcaggaaagtcagtggtttgattttagttcaagtctgcaggtctgagagccaggggagtcgatgatataaatcccagtccaaggacagaagaagactgatgtcccagctcaagcaggcaggaagacaaaggaggggaaattctgaaattcctccttcctctgtcccttttgttccattcagagcttcagtggattggatcatgcccacccacattggggagagcagtctactctactggagtccactgattcaaatgttaatcgcatctggcgacatgcttacagacacacccagaaatagtgtttaatctaggcaccccttggcctggttaagttgacacataaaattaaccatcacaccatctgaattatatttcataaatattttccaaatttataaaatggaagcaatagtgtatgtatctaatattgaaagcaatatatgttgtaaatataacatatagcatattggaagacctctctctctctccatagtaaaaattctgggaatctggaggggtgatagccaaaccaaaaccaggcccaacttcactatgaagcttggtggtggttgtccattcaggtttaatatcaatctgatattgattctagtcaggtatctggctgagatttccaggatagcaacaatgattccaggaatctttcaattgtctgtctgatctagagagatttggtttgaggaatgctcattgtgtgtgtagtaggtggagatctcacacttcaggtcccatgtcctggcttccagagcagcggctgcctgctgtttcctgccagactgattctaccctttatgtcgctcctaacttaagaactccagtccactcaagagagccagctggcaggggaagggaactaattgccaatgactttataattgaatgtatatttttctacagttttgctgtgacaataataataatgcctgatatttgttgagtgcctactatataccatgcctactttatatacataagctaattaatgctcacatgtagatttattgctattaatatccctatatcattgatgaagttactgaggcagaagtttggctagctcacacagataataattgatggagtcaggtaatctgttcttttaaactttaacacaatgtactgtatatacacctgtatttaaaacattgtaagggtgatgtggtgtagagaagaaagaggactaggttgagaatcaaagtatccaattccaggttgcagccattagctcaatggcctcagttaccaactctctgggtctcagtttctaaatctagaatggattgaacagctccaacttgaatattccataagtctcagtgtcaattcggtactttgagtgatgatagatgtacagattgatgtacctttgttttaatggcatatctttgtttcataagtgatttattatatcatcaaccatggtgaggaaattattcctcaattaaactttgcctcaattagaacattgttcatattggaatataagacacacttgtttctatttccagaaacccactgtagataatggcattattgtcaccagtgtctggaaacaatgaattaaaattctaaataaggctattctgttttaggtaattttgcccataaataaactgagaaatatgatggtatacaacagggtttagtgaggatttagtgacacattttgcagattctgtaactttaaaaatcatacacagtcatgtgccacaaaacaatgtttcagtaagtgttggactgcatatatgacagtggtcttataaaaatatagcactgcctttttactgtaccttttctatgtttagatatacaaataccattgtgtacatttgtgtacagcattcggtacagtaacacattgtacaggtttgtagcctagaagcaatagggtatatcatacagccaaagtatggagtaggctttaccatctagatttgtgtaaatacactctatggtgttcatactgagagacaggactagctggatttcctaggccgactaagaatccctaagcctagctgggaaggtgaccgcttccacctttaaacacggggcttgcaacttagctcacacccgaccaatcagatagtaaagagagcacactaaaatgctaattaggcaaaaacaggaggtaaagaaatagccaatcatctattgcctgagagcaaagcgggagggacaatgatcgggatagaaacccaggcattcaagccggaatggctaccctctttgggtcccctccctttgtatgggagctctgttttcactctattcaatcttgcaactgcactcttctggtccgtgtttgttacagcttgagctgagctttcgctcgccttccaccactgctgtttgccgccatcgcagacctgccgtgctgacttccatccctctagatctggcagggtgtccgctgtgctcttgatccagcgaggcgcccattgccgctcccgattgggctaaaggcttgcaattgttcctgcacgctaagtgcctgggttcatcctcatcaagctgggttccacggttctcttcatgacccgcagcttctaacagagctataaaactctgtgcatggcccaagattccattccttggaatctgtgaggccaagaaccccaggtcagagaacaggaggcttgccaccatcttggaagtggctcgccaccatcttaggagctctgtgagcggagacccccaccccccggtaacattttggcgaccacgaagggacctccaaagcggtgagtaatattggatcactttcgcttgctattctgtcctatccttctttagaattggaggaaaatactgggcacctgtcggccagttaaaaacaattagcgtggctgcccgacttaagactcaggtgtgaggctatctggggaagggctttctaacaacccccaacccttctgggttggggacgttggtctg

(The sequence listing continues in the following parts.)

What is claimed is:

1. A method for determining that a human has an increased risk for myocardial infarction (MI), comprising testing nucleic acid from said human to determine the nucleotide content at polymorphism rs3739998 as represented by position 101 of SEQ ID NO:2024 or its complement, wherein the presence of G at position 101 of SEQ ID NO:2024 or C at position 101 of its complement is detected and indicates that said human has said increased risk for MI.

2. The method of claim 1, wherein said nucleic acid is a nucleic acid extract from a biological sample from said human.

3. The method of claim 2, wherein said biological sample is blood, saliva, or buccal cells.

4. The method of claim 2, further comprising preparing said nucleic acid extract from said biological sample prior to said testing.

5. The method of claim 4, further comprising obtaining said biological sample from said human prior to said preparing.

6. The method of claim 1, wherein said testing comprises nucleic acid amplification.

7. The method of claim 6, wherein said nucleic acid amplification is carried out by polymerase chain reaction.

8. The method of claim 1, wherein said correlating is performed by computer software.

9. The method of claim 1, wherein said testing is performed using sequencing, 5' nuclease digestion, molecular beacon assay, oligonucleotide ligation assay, size analysis, single-stranded conformation polymorphism analysis, or denaturing gradient gel electrophoresis (DGGE).

10. The method of claim 1, wherein said testing is performed using an allele-specific method.

11. The method of claim 10, wherein said allele-specific method is allele-specific probe hybridization, allele-specific primer extension, or allele-specific amplification.

12. The method of claim 10, wherein said testing is carried out using an allele-specific primer that comprises a sequence selected from the group consisting of SEQ ID NOS:4382-4383 and sequences fully complementary thereto.

13. The method of claim 1 which is an automated method.

14. The method of claim 1, wherein said human is homozygous for said G or said C.

15. The method of claim 1, wherein said human is heterozygous for said G or said C.

16. A method for determining that a human has an increased risk for myocardial infarction (MI), comprising:
   a) testing nucleic acid from said human to determine the nucleotide content at polymorphism rs3739998 as represented by position 101 of SEQ ID NO:2024 or its complement; and
   b) correlating the presence of G at position 101 of SEQ ID NO:2024 or C at position 101 of its complement with said human having said increased risk for MI or correlating the absence of said G or said C with said human not having said increased risk for MI.

17. The method of claim 16, wherein said correlating is performed by computer software.

18. The method of claim 16, wherein said nucleic acid is a nucleic acid extract from a biological sample from said human.

19. The method of claim 18, wherein said biological sample is blood, saliva, or buccal cells.

20. The method of claim 18, further comprising preparing said nucleic acid extract from said biological sample prior to said testing.

21. The method of claim 20, further comprising obtaining said biological sample from said human prior to said preparing.

22. The method of claim 16, wherein said testing comprises nucleic acid amplification.

23. The method of claim 22, wherein said nucleic acid amplification is carried out by polymerase chain reaction.

24. The method of claim 16, wherein said testing is performed using sequencing, 5' nuclease digestion, molecular beacon assay, oligonucleotide ligation assay, size analysis, single-stranded conformation polymorphism analysis, or denaturing gradient gel electrophoresis (DGGE).

25. The method of claim 16, wherein said testing is performed using an allele-specific method.

26. The method of claim 25, wherein said allele-specific method is allele-specific probe hybridization, allele-specific primer extension, or allele-specific amplification.

27. The method of claim 25, wherein said testing is carried out using an allele-specific primer that comprises a sequence selected from the group consisting of SEQ ID NOS:4382-4383 and sequences fully complementary thereto.

28. The method of claim 16 which is an automated method.

29. The method of claim 16, wherein said human is homozygous for said G or said C.

30. The method of claim 16, wherein said human is heterozygous for said G or said C.

* * * * *